United States Patent 8,071,291 (GENETIC POLYMORPHISMS ASSOCIATED WITH VENOUS THROMBOSIS, METHODS OF DETECTION AND USES THEREOF) - sequence listing, part 3

SEQ ID NO: 463 - DNA, 163873 bp, Homo sapiens
tgctatttaaaagcatggagtcctcaggaactgagagtggggtatgggtgcatcatgggcagcaggacaggtggaggagagcaaagggtgtctggggctggggaggtgatggcgagattagacatgatttttacctgcagggagggctcacattggtgtttaaaatggttctggccagcatcacacggagggtggttggtgggattagggagactggttgttaggtgcctgttgcctagaaagatttcattcagatctcgtgcctgggcaccagcgtctcgtgagaactcaaatgggctgagtgtcccaggccgaagtgagaagagggaaggtcccaccctggtgaggcaaaagctccgggaaatctgtgttcatgagttctctgcctgcctgtttacctgtgggggtgcagtgtttcgagagggcctataggctaagtgaggtctgtggcctgcatgaaggaaagataaaatcatgtgtccctgagctctggaacaatactcaagagagttggaagaagcatgtggcccttctgaggaaacagtccacccaagagatggccaccatgcagctgataaggccagggagttacctacattgcacaaggggatgtgtacccaaagttcacctgatgctggagagacgttttctaaccgcagactagctaatcttggactgtagagctgctctgctccctaggaagaaatgtgtttgtgagaaccaggaaatatgggcaagcaagagcagtcaggtagtttttagactcacaatgcacattagagtagtaaaagtcccaagaacccctgctgtttggaaataatcctgtgtaaagttgctaagtcaagggaagaaaggcaggaaggaggagacagggagggaggaaaaggggaggaaaaggagagggaaacaaggaggcttcatcctcaggaacctccttaagtgagctgcctctctttatcgtcctaaccacacctgcagcctgaacttggtcagggagcttccctgtctgccctggcctgacagcatatgttgatggcacagcctttgctactgtcacctgggttcctgccacagccttgcccttgctgaatctgccatcctgatccggtgttttctctctggttgagtaacctgacccagcctccagagtgcctctccacattgactggggtccataccacaccctcagatacccccaccttcctgtcactccagtcatcctgccggacatcagtgaccagtgatgtgcttacagaagagccatagtggcatctatggtcctaggtggcttagatctggggaaggcctacagggctggctgtgcaaatacagctatttattgtgagcagcttgcagcttcaatgtcttttgcttctttccaaatcaccaagcacagagcagagaatgaaggaattgtctcatgaatgccatttggaatggctgtgtttgctatagagcactgccatccttttgctagagtctctgcctcatgtctagggagatctcacagttgggggtggggggtgacatgaagccatttgagggtggctatgctctgataccggagctggttgggcccccaggcatgtgaggaggagccagggaagggaaagaaagcaccttctgcctgcttccttgcttcctcgttctcttcctgccctttcacagccccgtggacaccacttctgagtggcctccctcctgttcacaggcacctctgagatttcctggctgacacatcgcatctccctctggccacagccaagcaacaccagatgtctgcagtagcagtaacactttggattcctgatggaaaactccaagacgagcctctgtgaaatacctgcttcattttggcttcattttcatgcctcattatctgacccatttacttcttacctcagggcacagaccacggctgtgacactccgtaaaatcctgtgggatggggaagagtgaaaatgacacaccggtggggcaaggtggctcatgcctgtaatcctagcactttgggaggccgaggcgagtggattacctgagatcaggagttcgagaccagcctggccaacatggtgaaaccctgtctctactaaaaatacaaaaattagccaggcgtggtagtgggtacctgcagtcccagctactctggaggctgagacaggagaatcgcttgaacccggggggcagaggttgcagtgagctgagatggcaccactacactccagcctgggtgaaagagtgaaactctgtctcgggggggaaaaaaaaagacacagacctctcagggcatggctgcttaggaggctatgaggctcttgcaagattttccccatttttcatggctgccctcagagaatagaattgccacaattttaaggataaagaaacaggcttggagaggccagaggcttgcccaataccacacacacaggggtgcctttgtgtttctgggtcaatgctgtttttcacacagactggacctcatgggggtcaggagcagtgggaccacctcgtgctctctccgcgctcataccttctcatggtgtcaatctccccttccctcccagacagagcaatgcatgcttgccaccttgatggtgcaagcatcactagatctgaatttgaggtgaggaaattcaaggcaaccacagtacacgttgtcccccgtcggacccagggaaaggcacttgagacaggagcaggcctgtggtgctcttggcacaaggcaaaatggaggaacagggtggtggtggcagggtgccctaacctggtcttggggggtttaagaagttcctgttttgaagtgtttcaatagccagtgagagtgagccatggagaataaaaatgtacaagtaaacagtcgttccacttatacacagttaaggacttgtgggaggggggcaagttccagtttttcaacatagtttctgattgaaagtgccattgtaaccctcattatggccaccagcttaaatttgagggctcccgttgccctggaataaacccctagttttcagacttcctggagccaccatccttcatctcttctgtttacttttttctcttctgtttaaattggagggccatttatgccctccccttctccttgctgaagttgtgtacacaatgactggcacagaggtgtttctacctgcacaggctcatgacattctcacagtcagcccatagatcggtttcttctctcaatctcagagataaggaaactgaggtcttaagtggttaagtcatttgtcccaggtcgcctggcagcaagttgtacccacagtgctagccaatgtctcgctgacatgtgtgggcaccacatgggcccatccatggtcagggacttttcctggctctgcccatagcatcctcattcgtcttgtttgcttatatgtttcttacaactacctcacagcctcaaccatgtctttaaaattattcaattattcatagagctggatttacaagtctaggtctccttcgtcaggggtggccttctccgctcctcctcctcctctctggaggtggtttcatcacagactgtaaaggttctgtaaaaaataatctagtccgtctgcctgaagcagttctccccctgcaccagtgactcctgctatggtatactggggtagttacaggattttttttttctttttttttttcgagacagagtcttgctctgtcacccaggctaaagtacagtggcacgatcttggctcactgcaacctccaccttccaggtttaagccattctcctgtctcagcctcctgaatagctgggattataggcacatgccaccacacccagctaatttttgtatttttagtagagacggggttttaccatgttggtcaggctggtctcaaaattcctgacctcaagttctccaccctcctcagcctcccaaagtgctgggtttacaggcgtgagccaccgtgcccggccctagttacagattttatttggctttcccattctcagtcctctagtaacaatgttcctcctttttttttcctttagggaattgtcttttctctaatcctaatccatatggctcagctgtcaatcacagtcctcctctatcccctgacaacagaggagagatgtgtgactgaggcctggccgagcaaaagactcgatccctctggccattgtgattggttcagggacaacttcgtggtcaaatgattacaattttaccctctccaagcggtgacacaatgaataggctacagtggtaccaatgtcagttttcatttgcccagttattcccacaagataaatatctggactgtaattgccgagttatacatatatacattttaaaggctggtacattttgtgagattgccccacagataggttggtgcaaatttacaccattccagcaatacgtgggagtctgctttgcacaccctagcaacacctggtgttgtcagtctttaacatttgccagtttgataagtggagacagctgttgaaacctgttctcgattctgggcctcccttgggtcatgttcccacatgcctgtccctaatgttgcctcctcggaccttatttctaaatctcttgcctgcttctttatccaactttattggtctgcttataacctggtgtcactgtactagactagaaagtgggtctttatcatatatatatgccttttctcttgaaactccttgcaggtgctaagaacggttttggaatctaataattatttgtcagatgaatgaatggaaactcctctgtgattcacccatttcctattcactgagtggtgccatgtggttgggtcaatgcgaacctggggagatgaatgcccaagaacaccagatttcaagaatcccaatattgtaatggttatattggatgcttaacatgataatggagcatgactatcccattccaggaaatgacactccccacaggaagtccttggttaaccagtctttagtgatggtctgccatgtctctagtgtggagtcaaaggacccagtccctggtctcaagcgactgaacatcagtgtgagaggcaaaactaacgaaagaaggattttgagtttaagtggcatctgaatcaggtggcatttatgaaatgcaatcctttgggaaaaatagaacatatagtggactggaaacgcttgagaatattttctaaaagaggcgattgttaaggggatttttgtgagggttagtcaggtgttctgggctctgccagttacattttgggagtctgatatcatagctggtgcggtatgaagcaatgttataagcctctaatttcccttaaattgagtttttaatcttttaggttgttgggtttggataccaatggtccaaaaggaaggtcctgattcctagtattttggggaggaatgtcacaacttgctacaagctcaccaggaggcgaaacaaatatttttgagttagggggaagggctacagttgtgggaattgctctcaggcttccccagggtagtaaaattcccaagctatttcaaaccaatgtttttttcttctttttagtggtgtcaggaccccaagaggtcacagttgctatttaatagaatagagcattctggccctcttaacagggaattgtactcagacttcgaaaggtggatagaaattagataaaggaagggaaaaggaagttcattccaggcagggtgaatgaagaagagcatttccatgagacttaatagtttataaggtcccttgacaaacataatcttttttataattccaagtaaccctgaagttatgatttattataattattagcatttctgttttcatatggaaaaactgaggctcagagaggttaaacaatttgttcaagctctctcaactatttttctttttttttttgagacagggtctcactctgttgcctagcctggagtgcagtgaaatgatcataactcactgcggccttgacttcctgggctcaagtgatcctcccacctcagcctcccaagtggctgggactacaggcactcatcaccatgcctagctaattttttaattttttaaataattttttgtagaggcaggtcttgctgtgttgcccaggctggtcttgaactgcaggcctcaagcaatcctcctgctttggcctcccaaagtactgggattacaagcgtgagccaccatggctatcctctctcaactgttaagaggcagggccggcagggtgcggtggctcacacctgtaatcccagcactttgggaggctgaggcaggcagatcatgaggtcaggagctcgagaccagcctggcgaacatggtgaaaccccatctctactaaaaataaaaaaattagctggccataggcgacagagtgagactccatctcaaaaaaaaaagaggaaaaagaggcagagcctaggcagcagccattgattgggaaaaaaaaaaaaaaggcagggtcaagcctcaaatccatgtctctgaccaggggtggtatccaaaatatttaacaactcatatggcacaggtacaacacagagactgcttagctgctcaccaaacccatttcctcttctccttgggttgacagctctccagcctccttactgttagaagtgatgcatgccactttcaggccagcctctaactttctggaagacatgtgttgcagttgacagaacataagagggaaggaacctggaccccaaatcccctcttagcggagatccacccacaaatcaggaatacccattttagactttatctgaaaaacaagctgcttttatccttgaatcacggtacgttttcgttatggcagccagctttaccataactaatacagacccccactgttagaaccgaggtgagctggtgcgcggaagcagaagcctggagacccccgcagtgcctgcaccaccctaggacagcaggtcctggaataatgtcatttagttcaacgtggttttgttctaacactgatgagaaaaaaatcgatccccagccaggccactgtctgtgtggagcctgcaggttctcctcacgtccccgtgggttttctctgggtactccagagtgtgggttgtgtgagtgtgccctgagatgggctggcgtcctgtccagggcgggtccccaccgggtgccctgagctgctgcgatgggctctgacacacccccaccttgaatggaataagttggtaaatcattatcttgcttgtttatattaatctttttaaaatgtatgtatagttcacatttatttcaatggttaatattcgaagtattttggtctctatttagaagtttagtgatgtttttacaaccggaagtaggctgtaggaacttaacttctgtttaatcaattagcctctgggaaaattggtttctttttacatcgttttccttagacattactgtaattggggaaagtacattctcaggcacttccaacaccattagtctgaggataatcctttgagaatgagctgcagttgctggctattacgggtgggaggaggaggacaaaaataatttttaagaaggaaggaggtccaagctgagcaccagcattgtccaccagtgggaccagaccgtggaagccttgaatggctaaagaggagcttgagcttaaaacaccccacaaagcgagctctagcagacccctgagtcggggtgttcggggatgaacatgagggagccccatatctcatgatctggtcaccccaagtgagacagcttccccacttgcacccaaacacacacactgagtgtgttctgtctctgaactgtaacaacttgctttcctgtgtatgtccattcagatcccctcacctctaagtggcatattttaatttcaggaattgtcatgctcttccctaagctttcctgccatcccaatcaaccagctaacaccacaggatccagtctgatttttaatgtctgtgaccccaagttctggctgcacatggaatatacatggaaaatggattaatatttgttgactgctcactacgtgccagacttggtgcaaagaatttaaaatagttcattagtcaccttctccatagttcccgtgacatccccaaggctgttctacaatgaatccccctaaccccctggccattcctgaagggagacaaggggccagaaatgcttggcagcccagtttttttgcctcagttaatatcaatcagtaaagctgtattgtttttacaatttaagccttccacatttcttattggacctatttgtagctgtttgatctttctgtgtacagtaaatgggatttcttttctgggatgctttgaaattggctattgctggtgtactggaaagtgattttgtatgttgatttttcacttggcaactttctatgctctcacttttaattcattttaaaatttattctctttgattttcttagtagataatcatggagctgataatgataattttttaacagctatattgaaatacaattcacatactgttacgggatctatggagtgccgtttttcttgccagaaacctctgtggctgggggtgcctttgcccaagttttgctcaggcctgctgggctcgttctgcccactcggcctggcaactgcgctcagctcatgctaccagcctggatcccacacctgccaagggcaagtcaggcatggagtggtgaggggtgtgtgagcgagcatggggtctggctactgagcagtcagacacgcctgctgctgcagcagggtgggcagttccaggtgccagtgtgggctctctgcaaggctatggctggaccaggcacactacaagcagtttccacagctggcaccagggaacatgtggtgcctggaagcttggagatgccaagaaccacagggccccaaagagggagtcacagccctggcttggggagctcccaggtctgggctccccgaagggccacagctctctctcctcttcacctgcaacgtggtgagcaagacacatctcagccctgtttgtgttacagctgttttagccctgccatttgatgggtcctggttcttgtcctgtgaccagaaagaatgaggtacacagaaaagtggagagtgaacaagacaaaggggagctttgagtgatagaacagctctgaggagacccacggtcctctccacagccagggtgtcctgacaagtgttcagtttttcgcagaaaggagaccctggagtgggaagcttctctctgcagacaggtcatcccatcatctctgcagctctcagcagagaggaggccctggagtgggtagctcctttctgcagctggtcatcctgatgtctgctcagctctggctgagccctgggcttttatgggcctcagagaggaggaagcacatgctgattggtccatgggcagccctgggcaggtccagaaaaggcaccacaagttcccactctggtctgtgggactggcagcctggcccctagccagccagccttcaggccctccttggcccaaaggtggggccactggggacccacccccttccacccaggaacctgtctgcctcctgctgcctttcatggcatccaggctgtagttgccaaggggtgcctgaaggccagcactaagctgccctcaactcccactcagcttccctcctatgctcgttggtgaccaaagtctggagggggctgaagcagcaggggactggtgtgtcaacactgtcccaagcatgcgcacacccagcctggctgagacatcacccagactcgggcccaactttgctccaagaacggagtaggcactgacagcagagagaagccaggcagtgggagcaggcacttctgagcctgggagggccgggtgtgccttcctgggcccccaagggtgcagtgatgcctgggtcagcagttgcagttggggcagctgcagctgtgcctggggagtgggactcctgcctgctctgtggagccagaggcccaggtctgcaatgacaactttagcagctgcagctacacccagaagagtgggtctcctgcctgctcccaaccccaagagtacagggatgcccaggtccacagctatggattgggcagctgcaacagcatccaggcagctcctgccccaactcagaaggagtgggtctcccacttgtccttagctcctgctggctcaatagagagtgcagccccagccatgcctcactgctgcagccagcgtgatgacagcagctgcttcagatggcctgcccctgccatcaataccataggattcaccccatttaaaggatataatttaatggtttttatatattcagagttgggcaaccataaccacagtccattttacaaggaatggcaacttttaaattcataatttttcttctcctttctctttttatttcttattgaattggttaggatcaccagcagactattaaataaagtagtaatggcggcagtgggccatcttgtcttgttcttgacttttctgggaatgtctaattttttgccactgaataggaggtttgctacaagtttttgttagttagcctttagcaaggaaagtttcctcctacctttagattgctgagaattttagattctaattcagaaataggcatacattttatcaaatctattcatgaaagcatttattgtgatgggaatatcttttctgcccttcatctagtcctgtagcaaattatcttaatagattctctgcttaaagctatctttatattctttgtgtataatccttttaaaacaccactggagtcaagttgctaataggtttattattattattattattgttgcctttaagtttttagtgagattagcccatagttttctttctttctctttctttctctcgttctttctacctttctttcctttctttttctttcttctctctctctctctatctcttcttttttacagggtcttgctctgttactcaggctggagtacagtggcgcgatcatggctcactgcagccttcacctcctgggctcagatgatcctcacccaacatcagccctgcaagtagctgggactacaggtgcatgtccccatgcccagctattttttttgtatttttttgtagaatggggttctcgccatgttgcccaggctggtttcaaactcctaggctcaagcaatctttgtgccttggactccaaaagtgctgcgattacagacgtgagccaccatgcccagcctagttttcttttctttcttcttcttcttcttctttgtttttaatattttgtggtgacacaaggtcatgcttttctcagaatgctttcaggtaatgactaagctagagtgaggaaggaacaagggcccagccattttccttgaacacagcctccacttatttgtttatttatttattttgagatggagtcctgctctgtcacacccaggctggagtgcagtggcatgatctcggctcactgcagcctctgcctccagggttcaagtgattctcctgcctcagtctcccaagtagctggagttacaggcaactgccaccacgcccaactaattttttgtatttttagtagagatggggtttcaccatgttggtcaggctggtcttgaactcccgacctcaggtgatccatccacctcggcctcccaaattgctaggattacaggcgtgagccactgtacccgcctctaatttgatttataattttattgcatggcttctagaactctggggcttcttgttggcctggcaaatacttggtcagatatgtatcctggtctgacagcttctcttacctaatcctgagcccaccttttctcttttgcaggtgtgacaaactgtttgcattcctaacttcaagtcaacagttgcctctcgaggagccaagatggccaaataggaacagctccagtctacagctcccagcgtgagcgacgcagaagatgggtgatttctgcattttcaactgaggtactgggttcatctcactggggagtgccgggcagtgggtgcaggacagtggatgcagcacactgtgcgtgagctgaagcagggtgagtcatcgcctcacccaggaagtgcaaggggtcagggaattccctttcctagttaaagaaacgggtgacagacagcacctggaaaattgggtcactcccaccctaatactgcactcttccaatgggcttaacaaacggcacaccaggagattatatccagcacctggctcggagggtcttatgcccacggagcctcgctcattgctagcacagcagtctgagatcaaactgcaatgtggcagcgaggctgggggaggggcgcccaccattgccaaggcttgagttggtaaacaaagcggccgggaagctcaaactgggtggagcccaccacagctcaaggaggcctgcctgtctgcctctgtaggctccacctctgggggcagggcacagacaaacaaaagacagcaataacctttgcagacttaaatgtccctgtctgacagctttgaagagagtagtggttctcccagcacgcagcttgagatctgagaacaggcagactgcctcctcaagttggtccctgacccctgagtagcctaaatgggaggcatcccccagtaggggcggactgacaccttacaccttcgggtactcctctgagacaaaacttccagaggaacaatcaggcagtagcatttgtgatacactaatatctgctgttctgcagccactgctgctgatactcaggcaaacagggtctggagtggacttcgagtaaactccaacagacctgcagctgagggtcctgactgtcagaaggaaaactaacaaacagaaaggacatccacaccaaaaacccatctgtacgtcaccatcatcaaagaccaaaggtagataaaaccacaaagatggggaaaaaacagagcagaaaaactgggaactctaaaaatcagagcacctctcctcctccaaaggaatgcagctcctcaccaacgatggaacaaagctggatggagaatgacttttgacgagttgagagaagaaggcttcagaagatcaaactactccgagctaaaggaggaagtttgaaccaatggcaaagaagttaaaaactttgaaaaaaaattagaccaatggataagtagaataaccaatgcagagaagtccttaaaggacctgatggagctgaaaaccacggcaggagaactacgtgacgactgcacaagcctcagtagccaatgcgatcaactggaagaaagggtatcagtgatggaagacgaaatgaatgaaatgaagcgtgaagagaagtttagagaaaaaagaataaaaagaaacgaacgaagcctccaagaaatatgggactatgtgaaaagaccaaatctacgtctaattggtgtacctgaaagtgatggggagaatgcaaccaagctggaaaaccctctgcaggatattatccaggagaacttccccaatctagcaaggcaagccaacattcaaattcaggaaatacagagaacgccacaaagatactcctcgagaagagcaactccaagacacacgattgtcagattcaccaaagttgaaatgaaggaaaaaatgttaagggcagccagagagaaaggtcgggttacccacaaagggaagcccatcagactaacagctgatctctcggcagaaactctacaagccagaagagagtgggggccaatattcaacattcttaaagtaaagaattttcaacccagaatttcacatccagccaaactaagcttcataagtgaaggagaaataaaatactttacagacaagcaaatgctgagagattttttcaccaccaggcctgccctaaaagagctcctgaaggaagcactaaacatggaaaggaacaaccggtaccagccactgcaaaaacatgccaaattgtaaagaccatcaaggctaggaagaaactgcaccaactaatgagcaaaataaccagctaacatcatcatgacaggatcaaattcacacataacaatgctaaccttaaatgtaaatgggctaaatgctccaattaaaaggcacagactggcaaattggatcaagagtcaagacccatcagtatgctgtattcaggaaacccatctcacatgcagagacacacataggctcaaaataaagggatggaggaagatctaccaagcaaatggaaaacaaaaaaggcagggttgcaatcctagcctcggataaaacagactttaaaccagcaaagatcaaaagagacaaagaaggccattacataatggtaaagggatcaattcaacaagaagaactcactatcctaaatacatatgcacccaatacaggagcacccagattcataaagcaagtccttagtgacctacaaagagatttagactcccacacaataataatgggagactttaacaccccactgtcaacattagacagatcaacaagacagaaagttaacaaggatatccaggaattgaactcagctctgcacgaagtggacctaatagacatctacagaactctccaccccaaatcaacagaatatacattcttttcagcaccacaccacacctattccaaaattgaacacataggtggaagtaaagcactcctcagcaaatgtaaaagaacagaagttataacaaactgtctctcagaccacagtgcaatcaaactagaactcaggactaagaaactcactcaaaactgctcaactacatggaaactgaacaacctgctcctgaatgactactgggtacataaaggaatgaaggcagaaataaagatgttctttgaaaccaatgagaacaaagacacaacataccagaatctctgggacacattcaaagcagtgtgtagagggaaatttatagcactaaatgcccacaagagaaagcaggaaagatctaaaattgacaccctaacatcacaattcaaagaactagaaaagcaagagcaaacacattcaaaagctagcagaaggcaagaaataactaagatcagagcagaactgaaggaaatagagacagaaaaaacccttcaaaaaatcaatgaatccatgagctggttttttgaaaagatcaacaaaactgatagaccgctggcaagactagtaaagaagaaaagaaagaagaatcaaatagacgcaataaaaaaatgacaaaggggatatcaccaccaatcccacagaaatacaaactaccatcagagaatactataaacacctctatgcaaataaactagaaaatctagaagaaatggataaattcctcaacacatacaccctcccaagactaaaccaggaagaagttgaatctcttaatagaccaataacaggctctgaaattgaggcaataattaatagcttaccaaccaaaaaaagtccaggaccagatggattcacagccgaattctaccagaggtacaaggaggagccggtaccattccttctgaaacgattccaatcaatagaaaaagagggaatcctccctaactcattttatgaggccagcatcatcctgataccaaagcctggcagagacacaacaaaaaaagagaattttagaccaatatccttgatgaacattgatgcaaaaatcctcaataaaatactggcaaaccgaatccagtaacacatcagaaagcttatccaccatgatcaagtgggcttcatccctgggatgcaaggctggttcaacattcaaaaatcaataaacttaatccagcatataaacagaaccaaagacaaaaaccacatgattatctcaatagatgcagaaaaggcctttgataaaattcaacaacccttcatgctaaaaactctcaataaattaggtattgatgggacgtatctcaaaataataagagctatctatgacaaacccacagccagtatcatactgaatgggcaaaaactggaagcattccctttgaaaactggcacaagacagggatgccctctctcaccactcctattcaacatagtgttggaagttctggccagggcaatcaggcaggagaaggaaataaagagcattcagttaggaaaagaggaagtcaaattgtccctgtttgcagatgacatgattgtatatctagaaaaccccactgtctcagcccaaaatctccttaagctgatgagcaacttcagcaaagtctcaggatacaaaatcaatgtgcaaaaatcacaagcattcttatacaccaataacagacaaacagagagccaaatcatgagtggactcccattcacaatcacttcaaagagaataacatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttatagattcaacaccatccccatcaagctaccaatgactttcctcacagaattggaaaaaactactttaaagttcatatggaaccaaaaaagagcccacattgccaagtcaatcttaagccaaaagaacaaagctggaggcatcatgctacctgacttcaaactatactacaaggctacagtaaccaaaacagcatggtactggtaccaaaacagagatatagaccaatggaacagaacagagccctcagaaataatgccgcatatctataactatctgatctttgacaaacctgacaaaaacaagcaatggggaaaggattccctatttaataaatggtgctgggaaaactggctagccatatgtagaaagctgaaactggatcccttccttacaccttatacaaaaattaattcaagatggattaaagacttacatgttagacctaaaaccataaaaaccctagaagaaaacctaggcaataccattcaggacataggcatgggcaaggacttcatgtcgaaaacaccaaaagcaatggcaacaaaagccaaaattgacaaatgggatctcattaaactaaagagcttctgcacagcaaaagaaaccaccatcagagtgaacaggcaacctacagaatgggagaaaatttttgcaacctactcatctgacaaagggctaatatccagaatctacaatgaactcaaacaaatttacaagaaaaaaacaaacaaccccatcaaaaagtgggcaaaggatatgaacagacacttctcagaagaagacatttatgcagccaaaaaacacatgaaaaaatgctcatcatcactggccatcagagaaatgcaaatcaaaaccacaatgagataccatctcacaccagttagaatggtgatcattaaaaagtcaggaaacaataggtgctggagaggatgtggagaaataggaacacttttacactgttggtgggactgtaaactagttcaaccattgtggaagtcggtgtggcaattcctcagggatctagaactagaaataccatttgacccagccatcccattactgggtatatacccagaggattataaaccatgctgctataaagacacatgcacacgtatgtttattgcggcactattcacaatagcaaagacttggaaccaacccaaatgtccaacaatgatagacgggattaagaaaatgtggcacatatacaccatggaatactatgcagccataaaaaaggatgagttcatgtcctttgtagggacatggatgaagctggaaaccatcattctcagcaaactatcgcaaggacagaaaaccaaacaccgcatgttctcactcataggtgggaattaaacaattagaacacatggacagaggaaggggaacatcacacaccggggacggttgtggggtggggggaggggggagggagagcattaggagatatacctaatgctaaatgactagttaatgcatgcagcacaccaacatggcatatgtatacatatgtaacaaacctgcacgttgtgcacatgtaccctaaaacttaaagtatattaaaaaaaaaaaaagacaaaaaaaaaaaaaaccagttgcctcttgtggcacccaactggcacatatgctatgctttccagtttggtatttagctttgtagatttctgattatttcctatactctggaagaattcatatatcatagaaagtattagacccttgaaaattagatgtaattcacaaataaaaccatctgagtctgtttgggtgtttttttagaaaaagaactttgacagttgttctaatttcttatgtgtttattgacctatataggttttctgtctcttcttgtgttcattttggtaattttgagagttgaacccaatctctcttccctgctgcaaaatctcattgcatagtccctacaaaaaaaaaaattggtaatttacactttcttagaaaattttgtatttcaatctaggttttcaattttttaaattaacaatttctttttgatcatctttggaaatatttaaaaaatatccatagttgtattttcttgcccatttcaaacattaattatcttttaaatttaaatatattttaaaatgaattttaactagatttgtaaatagtaatggtcttttcaaagatcaagattttgttttattaactaagttcatattttctgtgagtgttctacctcattaaattctgctgatttttatactccatccctctactttctttgagtttattttgctgccttttcattctagactattgatttcatgctctttcatttagtgttagccctacttgtttctaataaacttatcctgagtcccacttgggccatgtcccacaagcccctaaaacagggtttctgatggtcacttctttctagtttacggtttcctctttaacttaagagtaatgttaacttaagagtaatgttagagcaggagttcctaacccacaggccgcagacgggagcagtctgtggcctgttaggaactgggccacacagcaggaggcaagcagcctgagaatgagcattaccacctgagctccacctactgtcaaatcagcagcagcattagattctcataggagtgcgaaccctattgtgaactgcacatgcgagggatccaggttgtatgctccttatgagaatctaatgcctgatgatctgaggtagaacagtttcatcctgaaaccagccctctcactgcatatatggaaaaattgtcttccttgaaactggtccctggtgccaaaaatgttggggactgctgcattagaggttgctttagaacttccagttgggggaaaatacatacatacatacatacatatatatatatatatatatatatatatatatatatatgtatatgtttgttatcttgtatgtttcatttggctttttaatttttttttctttttttgagaccaggtcatgagactggctaatttttgtatttttggtagagatggggtttttccatgttgctcaggctggtcttgaactcctggctttgagttatccacccacctcagcctcccaaagtgctgggattacaggcatgagctaccatgcctggctgctgctttttaatttttaattttattgtgcagtggccagacaagaaggtttgtataacttatgctttttgaaatgtattggaattctccttgtggtcaaatacatgactcattttgtaaaaggactgtagatgcttgaaagaatgggtactttctatttatccagtataatattctattgatatatatatacattcaatagatttcagaattctattctgaggtacactgaagcatatgattagtatatctttttggtggactacaacttttatcaatatgaactctccctgttggccttgatgctttttatttcaaattgttgtttttggtgttaatattgatacgtctgtttttctagcaatttacctagtgttcgctgtttattatgtaataaacaacaatttacctgtccttgaagcaattacataatatttgatacgcatttaggtagcatatatagttctatacctttgttttcaaatatcctgtataatttcattttagatataacttttggcaacagcagtggctcattttttaaattttctttacctaaactgaaactctgtgtcttgtaataggctaatttaacctattcatgagtactgttattacatatgcgattagatttattcctgtcatgttattttctgtcttctatttatcatactttcttattttcttttactttttaatcttttcttcaggtgatcgttgttattccattgtttttccttttacggattggcagttatatatcctatttctattcctcttgtggttataattaaattttgatgacatgtacttgaacatagttttctaaaatgttttgaagtaatctagactattaacaaactacagcctatgggccaagttgaaaccaaccaaatagtcccatagactgttcttttggataaacatagaaattgacttttctgatcttaaagcttgaagtttacatttgctttatctgagttccttcctcaggaaaagaccttcaggcctctcaagaaagtagcaaagaactgaaactccccagatcaccacattcagacaatgacatgcctgacccctcattcatcatgattgcttccttgcccctccctggttcctgtttctttacacatcattacatttcttccctgctctataaaccccaggttttagtttgtcagagagacggatttgagactgagctcccacctccttggcacccaattaaagccttcttccttggcagtgcttgttgtctcagtgactggctttctgtgctgtgagcagcaggacctagactgaacccctggtattttggtaacaaaatcccacctattccacatttttgcacagcctagaagctaagaatttttttttgtatttgtatttatttattattgagacagggtctcactctgtcacccaggctagagtgcaatggcacaatcaaggcttacggtagccttgacctctgatgctcaagagatcctcccacctcagccccctgagtagctgggactataggtacacaccaccatgcccagttaatttttgtttttggtttttgtttatttttagggggtagagacagtgttttgctatgttacccaggctggtcttgaactcctgagctcaagtgatcctcccactttgttcttccaaagtgctggaattccaggcatgaaccattgcactcggcctttatatttttaagtggttaaaaaaaatcaaaagacaaataacattttatgacacatgaaacgtatatagcattcagatttcagtgtccataagcaaggtttcattggaacacagccacacttacttgtttctatattgtctttagatatatatatagttgtttatatatgtagctgcttttgtgctatcatgggagagttgagtggttgagacaaagactgtatggcccacgaaggctaagatatttgtaatctggccctttactgaataagtttgctgatccttggtctagatgtctatccccactccccatacaagagttactacagagattaattctttccagccaagactcactccatatcatttctatattgtattcgtttgggatttgagttccagaaacagaaaataatccaaatgttcatcaacaggtgaatggataagcaaattatgtacatcaagcacaatggaatgctacttttcagtaagaaaagaatgaactattgatacatacaacaacatgagtaagtctgaaaagcatatggctgactgaaagaagctaaatgtggaaggttacatactatattgtaacattaatgtgacattctagagaaggcgaaattacagtgacagagagcagatcagcggtttccaggggcgaggtgtgagggagaggtgattggctgcagaagagcatgagggaaagttttggggtgatggaaatatgttatgtcatggctctggtggtggttgcacaactgtatcacaactttgttaaaactcatccagaaaaacaaaattggtgaatttcattgtatgtaaactataactcgataaaactaaatttaaaaacctgtcctgggtaaaacaaatctttaatgaagaacgggaagaatctatgacaggaaggggcttgagagaacactctgaggtgatggcaattctttgtgtcttcatgggggtttgcattgtgcaggtttgatgcatttgacaaaattcagctaacacatatgcaagattggtgcatttcattgtatataaattttacatcaaagagaatatatcaaatattgaattctagttagtgatctgtatacttgaatatttagggggaaatgtactgaagtcacaatttactttgaaatccatcaaaaataagatggattagtgaatggctagatcaatagatatgtgataaagcaagtaaagtgttagtggtaaatgtcatgctaatggtgggtgttctctattaaattaaaataaaatctttgttctgccttgtaagaaggttgtgttgacattgaatggttgtatgcactcagcctggcagctggatccagtctctttaactatgtcatctatgaagaaatagtgttgaaacatttttgtacagagtacataccttactgtgctcatattcccttctttaaatgtcaaggaaaagacatgacaggacccaccccacgtacttgcctagtttgagccagcagctcacctggaccttcctgctttctgacttgcagctgtctttgttgatgatctatagaggcccctcctctttaagcctgaggggtacaagagtctaagtggttccctgggacctggtttactgactgctggaaccctggagatggcatgctggcaatgagagaatcttacggaactcaacttggtaccaatgccctagtgaaaaagtagtggagtccttatatatcagcattggaagggcacttagacaccattttacagatgaggaaactgaggtccagatagggaaaatggcttgccctagtccacatagcttcatgacagcaggttctacaccccagctctccccactctcagccctatttgggctgcagccaacctgacggttttttgagggcactggtgggaggatccctggggtttgtgaggtggtaacagccacagtgtgagtgagatctggatcccacctctggccctgtgaccttggacaagttatttaatctctaatactgggtttcttcaggagtaatatgagaagaacaatatcttttttgtcagggtattgtgaggtttcactggaacatcatctgtggagccatttatgcaatgcctagacctggtgggtgctcactctgtgggcaccactgtcattggtgtgctcatgagcgcactgacctgagattctgagaaaccagatgttggctctggtgctaccctcaccagctgtgactctactcctcacaagaatcttcaaggtcgtagttttatccgggttttacaaataaggaaactgatatgcgtgtccaacctcaaatcttcaaatctggatcaaacgcaaatattgtttctagtcattctcttggcaggaatggtctcagcacaatcaccagtaggcaaagtttattttagtgcttccttcttctctttccaatcttctgtccttctctccccaccaagtgagtgggaggaagagaaagttggggaccgtttgatgttcctgggtgttagtaacactcgagggagccacacttcccaggggccctcagggcaatctagaaagttcaccactcttccagcactggcagacaaatccagccagtgcctagaaaaggttcatttgtgacatccacaaggcaggggcactccacacacacttcgctgaccattcgcatctgcatcatttgggagcttgtcaaaactgacaattctgcctctgccccacccagacccactgaatcagagtctctggggatggggcccaagaatatgagttttaggaagctctgtaggggatgcttaggcacagtaaagtttgaaaagtactattccaagggaccagtaagaggacataggagtggaccagtctctgtaattttgccattttccaaaaagagacctctaatctgtgctgaagttcatttccaaggactgagtagggctgaacagggtaaatctcattttaaaataagtgttccctcattcctctcacagccctcttccaacatgttgttttcaccttcaacagaatgcctaagtgaaaaggagggatgcagtgtgtttggcagcgtggaaaagatcagaggggtgtgaaacgaattcatatctggcatgaccgagctctgttgggaggaccttggcagggcttgaagcagcctcagaagagaggtggaccccagccagtgcttaaaacaagaagcctgtcagctgctgccattttcctgtgttataggaagaccacagacccaagtcagacaggcccggtgtctaatccctgggaccttggatggtgactgggctctctctgccaaggggattatgtgtgttcgagcacctggcacctaggaagcattcagcataggctgaagtagcccctcctttgacccttgttgggaagggaaggcagtgccagacccatgccaagcagcctttctggtagctggtcttttggtcacacagggaacccccagaagcctcgcttcaagccctctccatagaaaacccacacagccagggtttgctgtggctcttctgccctgttgaatgtgtctccgtgaccatgtacccatctggaagactaagtgtgtggccaccttcactagcaaagatcaccctcgctccgccaggttctctccttcccactctctctgcacctctgccctttggtccttttcaagcactagcctctgtgcccagtctttggtgtggatgttggggcctttttagccatttctgtctgcatgactggttagtgggcagggggagtgacgagtgggctggcagaaagttcctttggatttcattagccctcgtggtgatcagcattgaggtaatgcatctgcaacatcacgtgttcaacctatgaagagtaaacttcccgctggcgtttctactataccttgttattcaaaaatggtatatgtctaggccaggtgcagtggctcacacctgtaatcccagcactttgggaggccgaggttggtggatcaccagaggtcaggagtttgagacaagcctcaccaacatggtgaaatcctatctctacaaaaaaaattctgtaaaactacaaaaattagccgggcatggtggccaggcaccagtagtcccagctacttgggaggctgaggcaggagaattgcctgaacctgggaggcggaggttgccgtgagccgagatcatgccactgctctctagcctgagcgacagagtgagactccgtctcaaaaccaaaacaaaaacaaaatggtatctatctcctccctagccttgagttgcattgtgagagcctcagtagttcccacactccaggaaagggggtacagaagagggaacacctgcctctccatcatgttgttattgattgattaatgtttcaccttgggcatcctcaaagctacctgaagaatctcactctgggtgtttcttcttttccttttacttgtactgatagggacccaggttctcaaataaggattctattacgaacacaagagctaagggaatggtgcatgaggatccatccacaaccatcgccatgtgtcccatggctgaggcacagggcttgggggtaacctgaccccacaggaggctatagaattagccatgcatgtattcaacaacaactaccctagtgtgctttgatctaaaaactcatcatgtgttatcaaaatgcatagtggtacaaccctcaaagccaattccaggccagatgagggctttcaggagggagatagagttagaggtgtaaaagattagagaagtttctaccaacatcgaagacccactcctcacccgctgctgtcctcacctctgttttatttgcatctttcttttttctttctttctttttcttttcttttttttccgagatggagtctcactctgtcacccaggctggagtgcagtggcatgatcttggctcaccgcaacctccgcctcctaggttcaagtgattctcctgcctcagcctcccgagtagctgggattacatgcgcacaccaccatggctggctaatttttgtatttgtagtagagacggggtttcaccatgttggtcaggctggtctcaacctcctgacctcgtgatccgcctatctcggcctcccaaagtgctgggattacaggcgtgagccaccgtgcccggccgcatctttctatttcagctcctacctctcatcactccccattcagatgacccccaaactccatcaccagaggcagaaactacagagttctacatgcagctggaaatgcctcctggagtttttgcatctggcagtgactatctcacctcttaaccaaacttaatcactggcagggagaacctcacttcaaatctggccccctgcccagctgggttcagtgccagggtgtggctggcacaagattaaattctgtaatgtattagcagcagagttgcatttaataaaagccaagagcttctgaatacacatgttggaagaaaaaagaagcaagatggagcttagtagccaagcaaaagccaggcatgggggcatgaggtgggtgatgtttctcttaggaccaggggtccaaggatctaagggtcatggagaaatctttgttagggctagaagacaatagcaatcagttaattcattccagaaacattcattggcactgttctagacactatgactgaaaagatggcaccagagatgactgaatatgagccaagggttttttgtttgtttatttttctgaaaattatccctcagaaaagactaattccatgtagtcttatattagaaaccttagtctcctctctccctccctcacttcctccctctattcttcccttcctttcttctttcctcccttccttccttcccctatttcctcttccttccttttttccttccttcccctctttcctcttccttctttccttccttctctttctcattctttcctctttctcttttcctctcttttattttcttttttctctttctgcatttctctttcacctttcctccctccactttttttaattcatctttttaagtaatgacagctgtctgagatgccgtcacctgaaatgacctcagtcaatgctagtttgtatgtttataaaggtcacctgatgacagtggtgaaaaaatcggcaaagaaatttgaacacagatttagtaagtctccctagggatatgacctcacaatgaaaagagttgcatgtttttgtaaataaggctttttaaaatcattttaaaatgcaacttgaagattataaatatatatctcctgggtaaatgggaggaaaactgtccaaatgttatttgaatgggtaattgtggtttgggttataattcccaatgtcagcatcagatgcaggttcagaaagtggtgcctctcaaacaagttaggaggaagtgaaattatgtaatctgagaaactgagttcaagactcaaaaagtgtcctagtgaagctgttaacatcccctttccagactgtggtcccagctacctgggaggctaaggtgggtggatcacctgagctcgggtgttcaagtggtagctgttctccctcctgccctcatacctcagccctagggtggggtcaataacctcttcagtactgattgctgattccaaaccatttgctctttccttcctaaacaaccactgggttgaatctcccttcgaatctcatcaaactataccactgaccctgtccttcttttttttttttctgagaccaagtctcactcttgtcccccaggctggagtgcagtggcgcaatcttggctcactgcaacctctgcctcctgggttcaagcaattctcctgcctcagcctcctgagtagctgggattacaggcacccgccaccacgcctggctaatttttgtatttttagtagagatggggtttcaccatgttggccaggctggtctcgaactcctacttcaggtgatctgcccgcctcggcctccaaagtgctgggattacaggcgtgagccaccgtgcccagccgaccgcctccttcttgaaggtacctgctgaccccaggtcacttctcatctcgatccttgaggactttgagttcattctcagtctctccagcactgtatttatctcacactgatttcaatatccacacagaagatccttgtgtacctctcagttctgtgtcctactgtccacctggtcacctccaccctaacctctcactcccacggtcgcaccctagaactgtcattttctctggctgcagttgtctgtcatcttggtttcttatttttttttttttttttgagaaggagtcttgctctgtcgtccaggctggagtgcagtggcgcgatcttggcccactgcaagctccgcctcccgggttcacaccattctcctgcctcagcctcctgagtagctgggactacaggcgtgagccaccacgcccagcctagtcatctcagtttctatgtcccactctccaaccactgtgccctgggtttccagctcactctttctcttatccagacttcaataatccttctaccagctgagacttagaatctatgacccaaccacctcttcatgaatcattagccccttaattgcctcatttcactccttagccaatgtagattcacagttgatcatgacagaacttccttgcccacattccaactcccactattggatttgccttggtgaacctcaccatgtctgacctggaataacaagatgggaagcagaacaacaacctagttctcttcctttatctctcatcctgctttagccattgctccctgctctgctcacctgtagacaaaactgttttttttttttttgagacaagatttcactctcactcaggctatagtgcagtggcataatcacagctcatcgcagcctcgacctcacaggctcaagtgatccttccacctcagcttcccaagtagctggatccacaggtgtccatcaccacacctagttaatttttttatttttatttttttgtagagacagggtctcactttgttgcccaggctggataattcttttttttttttttcccctgagacagggcctcactctggtttcctaggctggagtatagtgatgcaatcaggactcactgcagcctccacctcccaggctcaggtgatccgtccacctccgactccccagtaggtgggaccacaggcacaggccaccacacctggctaattttttgtattttcagtagaaattgagttttgccatattgtccagagtggtctcaaactcctggactcaagcaatccacccacctcggcctcccaaagtgttgggatcacagacgtgagccactgtccccagcctaaagaactttaagagtgttccagttactgtctccaattcccttcctcagaggtttgacgtgagctgtttcagtggagccaggtgacaaaagtcaaagaaatttcttgctttaactcctacccactaacttttattacctggctccaccgaaacagctcacgtcaagaccttgaaggacctccagctgccaaatgcaatgggctgttctcagacctcattttacttggcccatgagcagcagtctttgacagagtagctccctccatcctcttgacactcactccagggggtctcccctgcctcactggccgctccccacttctctctgcccgtgaacattggagggtcccaaggtccaggcctgggtgcttcctctgtcattccttcctgacttcaccctctctctaggactgaaggactcctaaagctagatctccagcccagacctttaccccaaactccagacttctatacccaacttaaaactcgacctttctacttggatgtctaatgggcaattcaaactttcgttgttttttttttaagacaaggtcttgctctaatgcccaggctggagtgcagcggtgtgatcacagctcactgcagccaaaacctcctgaactcagccccccacccaagtcgctgggactacaggcacatgccgccatgcccggctaattttttaatttttctgtagggatggagtctcgctatgttagccgggctggtctccaactcctgggctcaaacagtcctcccacctgggcctcccaaagtgctgggattacaagtgtgagccacccagcctggctgcacccaaacgacatctcctatccacctaatgtgttcctcttgttttttgttttgttttgttttgagacggagtcttgctctgccacccaggctggagtgcagtggcacgatcttggcttgctgcaacctccgcctgccgggttcaagcgattctcctgcctcagcctcctgagtagctgggactacagatgcccaccaccatgcctggctattttttgtatttttagtagagacggggtttcaccacgttggccaggctggtctccaactcttgacctcaagtgatccacctgcctcggcctcccaaagtgccgggattacagacgtgagccactacacccggccctcttggtcttctaactctcaaataagggcaactccagatgctcagacaaaaaccctgggggtcatttttgattgctctcttcctctcatgcccttcatggatcggttagtaaatcacgttggcataccttcagaacacatccagagctcagtgtttcttaccactgcttctaatatggcccaaaccacccacagtcctctcccacgtcgctgcagcagcctcctaactggtttccctgcctctgccctcacctgcaccatccactctccaccaagcagctggagtaaaccttttaaaaactcaagtcaaatcattctactcctctattcaaaaccctcctgtggcttttcatctcatgcaaagtaaaaccccaaatccttagcgatggccatgacgcgtgacgttgtctggtccccagcacccctctgaccgggtccgctctttccccacgctcactccacttgagctctgctggtcccggctcttccttggacgcactgagcatattcattcctgctttggggtccatgcactttgctgctcccttttcctaggagagttgtgcccacatagtcacagggcttgtgtcctcactttacatatcaccttgtcaaagtggccttctcagatcaccctgtacaaaagcccagacctacccctacccctgtcttcctgtccgctctgagtccagcttcactccttctttacagcacacatcaccatttgacatactcaacaacgacgtttccacagttctcgccttctccatggcccctgcatgtcatgtcaactctgtagactcgtctgttttgttcactgctgcatcctagagcctagaacagagacggggcacatagtaagagctcaataaatgtcaccgagtgaatgaatggatgacagagggcaattgtcagcaatggaaaactaattgcctccatttattgggcagattcttctgcgtagagttttttatttgcatttttttttttgagatggagtttcactcttgttgcccaggttggagtacaatggtgcaatctcagctcaccacaacctccacctcccaggttcaagtgattctcctgcctcagcctcccgagtagctgagattacaggcaagcgccaccacacccagctaattttgtatttttagtaaagatggggtttctccaccttggtcaggctggttttatctgcattttacgagaataccttgtgaaggagatacaaccgttcccattcacagttaacactgaggcagttaacacatgccatcagcctctgccccctctcctggggcagcccgttccccccaccccgagggcaggcctcactgggagagctctcccaggttctctcccatttcattaaatcttatatcatctctaagaaggaggggcctgaatccccactttacagttgaggtcaaccaagacttctctaatggcaaaccagaacttcaaatatggccatctcgggctagcagtgggatggaagaccagagaggtgtgaagtgacacccgagggagaatagtatctagtggagccagcacagccaaacacaaggaaaaaaattaaaaaattagccgggcatggcagcatgtgcctatagtcccagctacttgggtagggggctgagtccgggagattgtggctgcagtgagctgtgagtgtgccaaacacaaggaactgtgttccaggagcctctggctgtcatctctcttagtcctggggggcatccagcttgatcttttagtcatcattccagggggcgttgaagggtgtgcctttaatctggaatgctggaaagattccctgtccttacaaacgcaaaagtcggccgggcgccgtggctcacgcctgtaaccccagcgctttgggaggccgaggcgggtggatcacgaggtcaggagatcgagaccatcctggctaacacggtgaaacccagtctctactaaagtacaaaaaataagccgggcgtggtggtgcgtgcctgtagtcccagctactcgggaggctgaggtaggagaatcgcttgaacctgggaggtggaggttgcagtgagccaagatcgatccactgcactccagcctgggctacagagcaagactccatttcaaaaacaaacaaaggcaaaagccatgtctacatagagctgggtttttgggaactgccacgtgggagagtggaggggagattgggcaaggcttccgcagtgagccttggtttctggtgggtgcctgcagcttctcccaggagcctctcttgcctaggatgcagcatccccaagcagaggaaacagagctgcttacaagctgggctgagtgctaataaattcaaattgtatggaaatgcagaaacacttaaatattaaaaaaaaaagcacttaccagaaatgctttagatgcagagagaacacatgcaaatgtgttgagcttgtatatctcaccttccagataggaagcaattctattctcccaaggcctagctatctcaaccctacaagaagaagaccccaccagaaaggcctacagaagcccagacttaaggatgatcacagtctctaagtttaaaaaccaggacatgccatcaatgaatgaattaaaaaaaggtgattttttttttttttttgagatggagtctcgtctgttgcccgggctggagtgcagtggtgcgatctcagcttactgcaagctccacctcctgggttcacgccattctcctgtctcagcctcccgagtggctgggactacaggtgcccaccaccatgtccggctaatttttttgtatttttagtagaaacggggtttcaccatgttagtgaggatggtcttgatctcctgacttcgtgatctgcctgcctcagcctcccaaagtgctgggattacaggcatgagccaccgcgcctggcgagtgatatgtgtttataatacaatactatgcagcctttaaaaagaaggaaatcctgtcatttgtgacaacaggggtgaacctggaggacatgacgttaagtgaaataagccagtaacagagaaacagatactgcatgttctcacttctttgtggaatctaaaaaaataatttaatagaaattaggagtagaatagtggcatggggtaggatggtattggggagacattagtcaaaggacacaaaagttcagttaggaggaacaagttcaagagatctgttgtatagtgtggtgaccgtagttaatagtaatgtatagtatgtccgaaaattgccaagacagtagatgctaaatgttcttatcataacaataagtaggtgaggtggtaaatatattaattagcttcatttaaccattccacaatatacacttatatcaaaacttcatgttggaaagcataaatatcatttgtcatttgtcaattaaaaaaagaatcagacacatagtctcacaaatgctgtttctctggtttgcaattgtattcatgttgaaaatccagcaaatgctgctggctgtatacgcttcttgccctaatgctggactgaaaagcaggaaattctgtgagagttagaccaccatggatagactgggatgtatggtcaccgaaggtgtgatgctgaataagaagaagtttggtcaatctgggggctgaatttcaaggcccagcgcggtgcggtggggagaacagaggcttcacgtcagatagccctccgttggcatctgatactgtcccctcctactgaggacccaggagaatcgttggcaagaggattggtgataatgacataaggggcctcagcccaaggcctagctcatcaggcacttaatgaatggtattaatgtcacctctaactgccgttctccattcctgtggcctgctgggacttgtcaccaaagctgtctgggtaggggtgctctgtgcatgaggagaagcctcctctttcctgttcacctgaccctgttctgctatcctgggcatcagttaacttcacactaagtgctggaatcaaggggcatattcctctgcaggcattccagttagactctgtccctggcaaataggtttcaactcacttttcacctccaaacaattgtttaatactggtttggaccgggcgtggtggctcacgcctttaatcccagcactttgggaggccgaggtggatggatcacctgagttcaggagttcgcgaccggcctgactaacatggtgaaaccggtctctgtctctactaaatacaaaaaaaattagccaggcgtggtggtgcatgcctgtaatctgagctacttgggaggctgagacaggggaatagcttgtacctgggaggcagaggttgcagtgagctgagatagtgccatcgcactccagactgggcaacaagagcgaaactccatctcaaaaaaaaaatatatatatatatgtatatatatatgtatttgaagtgccctgttgagaactctgggcttctagaaaacaatgctgcaattgattggtaatgtcggccatggcctaggagaagagagcagggcacgcaagctccatggtcgaattccagacccagggctccctcccaggcaggctgctcacattgggctccccagaaggtgacgccaggacaaggatttgtgtgcaagtagtttttaaagaagggataccaggagtggggagtgggacaaggaagggatagaagggaagagacagaagcctatacgggggtgctaataagtgggttcccactaagttacagaggcccacctgggggcacctctgggagaggacagggaatgttcctcagagttttccacctgaggggagagggagggacaatttatcctgccatgctccccagcctgccagcccaccccacagtgagccctgagttggaggtcctggtggctgtgggagacacccttgtgcactcctggacaaggtgccaattccagaagtcccagtgccctgccttatccaggaatggccagctctgcactgacagtggcactgaacccaaagttcacaaggggagattctggagttggccaaacctgggttcaaatcctggctccagctgtgtgactttggcaagttactggatttctcagcatcccctaacaacctagaggcaacaatttgggttgttgcgagggtcccctgatactcccctctgagatcttccctgacactcagctaactcagcatctgcctcccccacccctgtcttgcatctgcctggctctgcacacacatataaaacataaatttcccagagacccagcctcaatctacttgagaagatctgggaagagagtctcgagctgccacaggggacataaaaacaggcaaattgcctccagacacaacgccagcctggagatccccaacaggcaggagctgacggtccactgccgggcagagggaggatggttgacaggccttttatgctcatttttaatgacctttttaaaagttctgtttttgcttttgttttataacatccatcagaaataataatgttgtgcaagtatacaattgatgcagaagcagatacacatattagggagtgtgctcaaaaatattttatgagtgcataaccaaaaaactttggagacaactgcaatcgatcctcctttcttggcctggataacgcatctggccttgcttgctcttaactctccccacaccctgctctgcttgtctcactctcttctcataaattatgtcttgcgaaaattcagtccctggcctctaaaagtttagaaaggaatctgttacatgttacttgtatgaacaccatgagaagccaaatcctgccccgtcccagccttggattatttttcctgggcctctctcccatccccacctcctgacccatctcccacctgtgctccagccagaccacaccttggcaatcctccaggcagagcctcagtgtcccaccccaggcatttccacaaggtgtgtcttctcccagccctgcaggtcttaatcgcctctggctccaaagcccaacacagacgccgcatctaccacaaagcttctctggatcctgaaaccaccaggagacacatcctctagtgcttcctggaaactgtacctgacatgtgcccagtgagacctgacacatgctgctttgggtcaggacatgctacataacttgtggggctcagtgcagaatgaaaccgtgggcaccctgtttaaaaagggagaaaaaggtgttgctgaaagtgctaaaatgtaaagctttctcctttcctccacggtctctctctttcggcatgtcatcctgttttttgttctctattgacgtccgtgctccatcaggcacgaggataccaatatcagtgcagaccctcacaggcacctgggcccccaccctctaccccggagcccatagaccactggctgccctgatcccctcccactatagctgctgggtcagcatgttgagttatagctgctgagtcagtgtgctgggccgggcatctccctattccatgggcctgctgccccaacccatgggggacggtagacccccagggatatcaccatttctgcgctgggatgctggatcaggggtgagcaagaggtctacccctgctgattgacccaccaagcatagtgttaagctgcccccatgccttccacaccttaaagaactcacagtcttgggtagtatttctcaaactctgagtaccatcttcccatatttcgctacaggtactatcatttacttaatacttttattttttagaaggggtctcactctgtcgcccaggctagcgtgcaatagtgccatcatagctcactgcagcctcaacctccagggctcaggcgatcctcccacctcagcctccagagtagctgggactacaggcatgtgccaccaggtctggctaattattaaacattttttagagacaagaacttgctttgttgcgcaggctggcctcaaactcctggcttcaaacaatcctcctgactcagcctcccaaagtgctgagatgacaggcatgagccactgtgcccagcaaatacttaatatttttctttagagtaactaatttttttacctgcagtaagtttgctcctaagggagtctatgtacccctgtgcaattatcttaatagatggaatgtgataatcacatatttttctaatgcacatcaaaatcaatactaaactattaaaatgtttaaaatgcctgttcacatatcaccaaacggcatctcgtgggccagccctggaatgagctgccttcagggaaacactgattatattgaggaggtttgacttacacaatgtgcaaggataattataacataaagcagggctggtcatgtttgagaccagtgtgaggccctcacttaaaaggcctcacgtttggggtttaatgctctgagttgattatcttgaatgttttttaccctgagatggagtttcgctcttgttgcccaggctagaggggaatggcaaagtctcggctcactgcaacctccgcctcccaggtacaagcaattctcctgtctcagactcccaagtagctcagattacaagcacctgccaccatgcccggctatttttgtatttttagtagagacagtgtttcaccatgttggctaggctggtctcaaattcctgacctcaggttatctacccgccttggccccccacagtgctgggattacaggcgtgagccactgtgcctggcttatcttgaaatttttaatgattttctctttgagtttgtgttttgtgagtcgatgagaggatgaggcgtgtgctggtggtttgggccttggcttacgtgccatcatgccttctgcacccttccaggatggggtctagagcatcacagtcagtaatgagccaaagctgggtgactaaatgaacaaatcaactaatgaaaacatggacacccaggagcctgagcttctccttttaaaattttgttaagtaggactgttactgattaaccagttcactcaagattaatgtatacacattttagaaaaaatgattaaagaaattaattcctttaaaatatgtaggcggtggctcacacctataatcccagtactttgtgaggccgaggtgagtggatcacttgaggtcaggggttctaggccagcctggccaacatggtgtttgtgtctactacaaatacaaaaattagctgggcgtggtggcgcatgcctgtaatcccagctactcgggaggctaaggcaggagaatctcttgaacctgggaggtgaaggttgcagtgagctgagatcgcgccactgcactccagcctgggcgacagagcgaggctttttctgaaaataaataaataaataataaaataaaagatatagaagcttgttttggaataacctgcctgcccacttttttggggcctttttctgaccaggaagttcaggcatgtgacctggagacaagcaaatgtaccacgtgatgtgaagtgaactctcagccagccttgggcttccttagcctggggactgcatcctccaggtggtctgagatgacactctgtgacatgcatttctcagggtttaccttgtagggctatgtgactagcaactagcaagtcatacccttgggaggccctgggtgaatacatggccaaatatttatcatcaaaagttgccagcccttagagaaatggcctccgtcttcatctttcaatcaaatgtcactttatcaaacaacagagccacaacatttttaaaaggacaaagactgaaacgtcacccatgacaaacattttggaaacaagattttctaaaatggagaaaatagaggaacacatagttcgtggtcataggctggccacaccacctgccacttcattagtctttgcctggggactttttgtttcctgataatcattaatatatatttttatgggttgtttactggctacatttaatagatgacaaaaaggacagtctgaatatgttgttttccatcaactggaacataccactcacgttttccgtattttgtatgagaatcttcattctgaagttttgcagtaagcattttgagtgaatggacacattttaggactgaccacataaatcaagagatggatgtacattcttatttcattttattttttagtttttaattttttttagacagagtcttactctgccattcaggctggagtgcggtggcaagatctcagctcactgcaacctctgcctcccaggttcaagcaattctcctgcttcagcctcccgagtagctggaattacaggtgcgcaccaccacacctggctaacttttttgtatttttagtagagacagggtttcaccatgttggccaggctggtctcaaactcctgacctcaaatgatccacctgcctcggcctcccaaagtgctgggattacaggtgtgagccaccatgcccggccagcattcttattttagaagtcaaaaattcacacatcattttgctttccagatacactcggtgtttccagttcttagtacattcttccagatttcgtctgtgtttctgtgcaagtgtgtggccaagtgtgcgcatacccacactgtgctgtctgttactcactgtgcctctttcacttgactctacctgggacatcttttctcgtcagttcataaaaatctgtctgatgagaggactttttaagatgactcatcaggccaggcgcagtggctcatgcctgtaatcccagcactttgggagtctgaggcaggtggatcacctgaggtcaggagttcgagaccaacctggccaacatggcgaaaccccgtctctactaaaaatacaaaaattagctgcgtatggtgtcaggcacctgtaatcccagctacttgggagggtgaggtaggagaattgcttgaacctgggaggcgcaggttgcagtgagctgagatcgtgccattgcactccagcctaggcaacaaaagtgagactccatctcaaaaaaaaaaaaaaaagacgactcatcagacacatttttgggtcaggctcaaatgaagttcatgattgcaagggtattctagactgacccaaagattttctccccaacaccaaaaactggaaaacagcctgacagtcattaattcctgagggaacagctgactcttctgagaccatctactctctgcccacaacctctcctgcataccccagctgtggctctgctattcatcccaaatgtcctggccaggcccacccacttggccaaaaagttgacttcccagccagacctggttgatcaattggccactatccttacaggaaaagtctgagttatgagaaaaaaaaaactaatttcttccaaaatataaaaagaaaactgcatgatcaaagtgaataaatgtttaattaaatgcctgcaaagtggaacactatgtcagcttccttaattgatacattcagtatttttaaaaatttcattacatttgcaaaacaaattgaaagtagcatttcctcctttgcaagaattcttgaggagtgtgtggtgattgccaagaaataacaagttgctcatgtactattattttaaaaagaaaaattatcaaaaccatttaaaaatattttgcaatattaaaaatacacatgatcctgatctgatcactatacattaaatgtatcaaatcatcactatgtattccataaatatgtgcaattattatgtgtcaattaaaaataaacaaataaataatacacatatgtgtgcatatatgtgtatatacatacatatactcagtgtgggctgtttgatgtgttattggaacaaggtctttaaaagtaagctgaggggcactttgggaggctgaggcaggcggatcacaaggtcaggcaatcgagaccatcctggctaacatggtgaaaccccctctctactaaaaatacaaaaaattagccgggcgtggtggtacgcgcctgtagtcccagctactcgtgaggctgagctaggagaatcacttgaacccaggaggcgcaggttgcagtgagccgagatcatgccactgcactctagcctgggtgacagagcaagactccatctcaaaaaaaataaaaaaaaattaaaaaattaaaaaagaagctgaggggctgggcgtggtggctcacgcctgtaattacagcactttgggaggccatggtagattaatcagttgatgtcagtagttccagaccagcctgacaaacatggtgaaaccctatctctactaaaaatacaaaaattagctgggcatggtggagggcacctgtaatcccagatattgggaagctaaggcaggaaaatcacttgaacccaggaggcagaggttgcagtgagcccagatcgcgccactgcactccatcctgcgtgacagagcaagactccatctcaaaaaaaaaaagtaagctgagggctcaagggccacacaggtcttcaagaggcccagcccgggatccgcacacccgagaaccctgtgctgagtcaggatccccttctgtggacacaagataggagtggtgctgtcaagaggaagttctaaaaatagaccctaacatgtagggcagaatattagtggttctgagaactagcagaatcagaggcagaaatgagacatgtgaccaaaatgaaaccccacagcccaaagggtatctccctggctcccctgggccctctagaaaaactagcaaaaaactagaaaagctagtaaaactcttatcattggagccagtggcattattggcctctatccccactaaaatgtgagtaacttcaaaagaaaatgctctttttttcttcctccaaaaacttaaagtgtaacatgtataaagagaatgcatctttttttttttttttttaagacagagtcttgctctgttgcccagactagcatgcagtggcacaatcacagctcactgcagcctcgacctcctgggctcaatcgatcctcccacctcagcctcctgagtagctgggactacttccctaggggtcctaaggaacccacccaggggtgtgctgggcagtgtgtaaccacagctctctgaaaacaaaagcccttaaatccctgatgggtagaattgccagttctcatggtgtccctactcccaccatggtgaccaacatgaaggtgtggacgtggaactgtgaggagaggagcatggtcagcttttttgagctggtatgagctagcttcagcacatcactgcatcccccagatgtgaaatctgaggagtaaatatccaggaattcagagaaatcctgggaaattgggcacgtctttcctttctcaatagttccccaaaagatgagaggagcatccctggctgcaaatcaggtaagttcctctcagggtgcagctgaccctgattcccaccttgagtcccttttgcaatggggaggaagtgagagcagtggctctacccaaaccaaagcttgggggtgtcgcaccttgggtgggactggctccacagtgtaccagctgtgtgaccccggctgagtctccctgacctccggttgtttctctgcagaatgagtgggcacaaggaggatgaagagggctcggggcaccgcctggcatggatgatgccatctgtcaaggagagtcactggtagtgtttgagtccttaagcgcactcactccaggggaaatggtgaagtggatggccattgtcctgggaatctttgggactgtacatgacgatcattggggctcttttgtttttctagcccatcaatgactgacttcagacccagcagaataagaaagccttaaactagtagctttatgttctttttctggatcttcctctaaattctgcaaagtaagtggcagtgatccattttatagatgaagaaactaaggcccagagaggcaatatcatgtctggccttgcttctctgtgacttatttgacttcttcctttggagaccctgagagccaggcaaacgttctctaggacagacaggcaggaaggtcagaggtgggggtggaggcactgcttccaccccaccccctgcagaagaggcaggagtcagctgggacagaaggggcagacctgtgagaggcctaattacgcatcctctttcctgccctccctgtggcatctttcctgttccttgggaaacactctaagatggacataggtgggcagacagtttattgtgtgccctggagtcaggacacacaaggagaaggagggagtggcggtgggagaaactgggctgtgatacagtcccaacaaagaccttggccaagccctggaggagcgctggagctgggctggacgctgacagctgccctgagttgggacaagagtacctggcctttatgcctttatattgaccagtcattggatttgggctgaattgctcccaaagagggcttagctgagggacaaccactggggtgcaggcccttcagtcctggaggagtctgggtagcaccatgcctagtccaagtggaaccggtgtctccacgagaggcaatttccctctgagtcttggaggccacattcctgagagagagagtgtcatgaccccactcacttgtctgacccaagctacccaggtcaaggggcactggccaacccatggattgaccagtgtttaggtgaggcatgcaagagtctccaagctaaattaattaataaatttagagacaaggtctcactctgtcaccccggctgagtcttgtcattcctacaggtgaattggtagaggagggacacaacctgttggcttcagtgtgggaaaaaggtacaaagagggcatgtgtcacctgtctgcctccctctcccaggtgagcagctcctgaggaacgcatgcctggattcgggatctcatatagtgtctgccctgggaaggcccccaacagctccaccctttcctgaagaagaggaaggaggtgggtatctttggaggccccagtcccatctcatagcacagtacacaggggcatctgcaggactagagggacggctcccctgcctcgcaccccctcctccccaccccatgagagaggtggggctcaagaacccccacacaatgtcttcattgacacttgtggccaagtcagcttctgggtgccatggaaacctctcttgggagccctgagggaaagcaacagcccagccctcccacactaagctcattgtcccctgagcagtgagagcagccccttatcagccccttcccaggcctgcagatcctggcttccaccccatcagcaacatgagctttcctcttgccggccaggcctggggagctggaggggtctcatcagtcacagaatccaccacctgggatcctgtactccttggccccttccttattccccatgaaatcaaaggcagccccagtagtgaggcaagagagctcattttttagttgcactaaaaatttttttagtgctcattttttagcccattttttagttgtgctgagccttgagagtggagggggcaccaggcagagagaggcccctccctctgtttggggcatacttatgccctgagccagccacagtgtccctcaggcctgcaggaagaaggccaggctctggaataaatccatctgggccaccccatgcctggttctggcttcaggctccactcattcttttctcctcccccaagtcctggaaacttccccagaagtccctcccctgccagtccctcccttccttctacctcccatgtctccttgggccaaggcccatctgcacagatcctggcagaataaagtcagagaatgtcagggccagaagaggcctgagaaatcagagccccgcatctctctgccattccatccccacttaccattttatagaggagaagctgaagctgggtatgaggagggacttgcccaagatcacaagccagggccttcccctccattgggcaccatttcaccggcctcatgggctgcttctccctgctctgacccagaacttgatcatcacaaaccaggagtatgccaggtctttggaagcagtaaaacctatagagattggaaggccccgacccaaccctacccaaagtaggggtgtcagcaactagaaagaagaagggctcaggattacagcacctcctcccttcagctgtctgtcacccaggtgtccccataacgactccctccacagatacccagatggccaacaagggcagctcccttgaaacaaatgtcccccgaactcctcagccccaggagggaggggccgttgggatgggcagcccagagagcctgggctttgcacccagagctaagcgagctcaaatcccaactgggccacctgggacaggttatgcagcctccctatcaccctctgtagaaggagaatcacaaaaaattctacccaccttatagggttgctgtaaggattttgcaagatattggatagaaagtttcacacaacactgggcacagagaacacagagtgaacagatggtgttgctgttctcatctatgacgaccttttacccttagaactctgggcaccaagttaggggtggggtgccgggtggggaggagtgccagggagccaaggggaggcccttaagtgacgctcagagaggtcctgaccttccccaaagcaggagtccttggcccaagggagaatgagtttcggacagccatgtggcccccagtaaggggccccctaacattccatttgggctttaacagggggtggcctggaatgtccaagaaaaacaatctggttattctgagtgaaattacagcctggctaaggcaggctgggtctgctttaaattaaacatagcatttctgagattcttttcatctccttgccactgcgggttagcggagacattacctcacctcaccttccactctgaggtgggaggccgacagggtgtgggcctgggggtggggacgagagagggaggccggagagcccaccaaggggggccaggggtccctcctcactccaagagctcaggctctcactggggctgggagcagtggctgtgtggggaagaggcgcacccatgcacagcccactccatccttggcatttagcaaaggaatgacagcactttcaaatacactgctttcctaggagcccttggggaaactgggttgcggtttcacaggtccaaggtcagtccctttcttgctccctgtcccacacttaggtgctgggtggccgcgcctgcgagctcctcagaactccagggtgttttcgctcaaaaacagatggagacaccagtttcctcactgagtggttttggttgggggtggagttccctcctggctttggaagttgcttttggccagctttgcctgcctgtggagtcctagaaaattccacagtgctgcagtcgggtagacccgagtgtgagtcccgcctcccaggataaggttcaccttatcttactcagatcctgaatcccctcttctttaacatggggaaggagacagggttatgggttagatgaaattaagcatgtttgaggttcttgttttagatgaagtacacccaaaattctttggttataagtttctatgaaacttgaggaagtttctatttcttataaccaaagaatgttgggtatacttgaaacttgaaactttgggtatactagaaacttgaggaagtttctatttctgccttgtgtaaaacggaaatttttttttttttctgaaatcagggtactctcatggaaacaggctgcaaaacctctcagagaattggaatcaggaattaggaaagggatttgcagtttctctccctctgtctctgcctgttctcgggtatttgcttccctcagggcctcagtggtaggctcctgtctgtacaaaccatttactcagagccccagccttggcctgacatcatttcctcacgctgggtccatggttagagctcagtgaaagacagcaggtttctgttgtgctgcttggttttgcacatcaatattagcatgctgaagatttcgtttgtccctccagacccactcgctctcctttcttctccaccttgccctgatcctgggactggcctgtaggaaccacgtcaactgagctcccgcaccttctgggttctggttgagttcagcccatcgtggccagcagcagggaataggagggcaggaggaaagagccatcctggcacttactgttctccctctttgccatggggggtggcttggtggtgaagtgtctggttcctctactgaaggccatggcacactttccagcaagcccctcctttggctatagctctgtctgcgttcttttgttgttattggtttttttgcttgtttgttttttgttttttgttttttttttttgagacgaagtctcactctgttgcccaggctggaatgcaatggcactatctcagttcagtgcaacctccgcctcccaggttcaagtgattatcctgcctctgcctcccgagtagctgggattacaggcgtgtgccaccacatccagctaatttttgtatttttagtagagatgggatttcgccatgttgaccaggctggtcttaaactcctgacttcaacccacccacctcggcctcccaaagtgctatctctctgcattcttgatgccacgttcccgccttggtccttcacgcttagggtggtgatggctccccactgttactatcccagaggtgctgcaccatccttgttcatttttttccatcttgcccatgtctgctcactgtattctctccagtgactgagctgtaactttgaattgccatctctctcctgctgggactctgactgatgcaataagatcaaggggaagtcagctttgtctctttgccccacctcccactccggctcccataggaagtggatgaagagctctaggtttgagataaacattagcaataagatagaactgagcagatacccgttattctgctagagtgaaaaagaatgcacgtgcactgggtggagttacttcttttgtaaaaaacttcattttcccgggagaatgtgaccactgggaagaggcagaaatacgctatcaatttggtcagggctctctctttttctgggcacacagatgcctaaaatttcagcatcatacagggtgtggacagaaaatatttttaaattgtcaacttctaggtatttttcactctcaaattcataggattagtcaccggaatccctgtcttttcctttcctttggcagtttggctcatggatatcttgcttttggctttgactactacaatagcctgtgaccctgtctctggtctctttttccctgtctgttccacagccctctgtcaagtttgtcttggtttgacccaggtctatacatgtcaagacccagatcaaagcattttatggcttcctgctgaagtgtctgaacacttcagcctgacattcaaggcttctgcagcagtcctcaactttctggtctacctcctatttcaggaacttcccacacctgacaaatcagatcttcctcactgaccttccaacccctgctcccactctctccatctgttcttcaacatgccgtccaaatcccacatcccagctaaggccttccctgcccactcagatggaggtgactcctcacggttaacccctgccattctgaagtgggagtgctcagagattaaggaggaagagctgatggaaagagaaccatattcatacaccagttgcagcctctgcactgtcctgtttggatatcattcagggacacacagaggaccctctgtgcacctcactgcacagatgcatagccaacttcatcccaaaggagctaaggggagaccctgtggctccaggcagtgtcaccttctcttcaggcctctccattacctggttttgtcctctggcttcatcatgtgatggtgccggtcactctctcttgacagaaaaatctggggccccaggttgtgtcatctgagtgcttggatcaaagggtaagacaggggaccttaagcaagtatcaggaagaacttcacccaggaggtgccttcacagcacaatctgcctatcttcagatggggagtcctgacctggccttgtgaatgctgtgggaccccaggcctccttttgcccatatagaaagtccaagtctttgctgcttttgaggttaagcatcagttggtttcaactatctttggctacacacacacacacacacacacacatacacacacagagctttgaggattcataatacttttgctcattcaatcttgagttgcaattgctttgaccatagcaacagagtcctccataacaaaggcctttacaacattttaacagtgaatataatgcaattaattttttgcagcaattaattacacatgcgttaagaaaccataaacttgtagatttctgtctctccctgggaaaattctagaatggttcattaaacattaggttgtgactacatagaatataaattagaaataagaagaatttaaattggaatatttttaagttaaaagaaaaaatacaaatcattggaagccaatatattttctaagaatatatcatgtcaaattaatctcattttcttttctcgcagagtcaacaagctgatctgttagagatttactatagatatagatttgaagaattttaggtgaaatgcattggtttccacaaagcacataggaatcctctcataaaagctgtgatagtcattacagtggtgcatagataatcagtttttcctcctctcatccccatagtaaggttgtattttcttgccttctttgaagttagatgctatcatgtaatctgctttggccaatgaaatgtgagtggaaggacaccccatgatgaatgaatcaaggtaccaggtaattcttggatgaacactcacagacaataaatgaagccacgcctgggcagcattatcagtccctccaaagggcaggctaaagagagaagaacctttcaaagtaaataatggcaatgactttggaaacaaagaggtgttaatcagaagaaagtgcttgaagtgacacaagtcagccttctgggtgagacgtggggcccaagcatagacacatcagaatcagggtggtcagagccaggaggcatgacaccacggtctgtctggtggctggctctgtgaccttggccagttcatacctttgagcctctgcctccttcccatatgtgactgggggctcgatgaggggtaagtacatttagagagaaaagctgccaataacttttccatctctgtggatattgagagtcaccttggattagatcttggttgtcttctccccctgaaccttactggccactctgaattgtgcaaaaacaaaaaaaggggcccctattgccacagggccaatgtatagtaggagccttggcagccaagcaagatctgtttcacccagcaccctctgtatgcagagatggctgcctgggggacaaggaagttcctggggaggcagaattaagacccccaactgcttcccctctgaatatcactgtcattaggacctcccttgtggattggaagagaccctactcaggacatcattatcgtgaaagaaaaggagggcaacaaggcctagaggattgtggggaaaggctgctcctggccaagtacaagaacaagtataataatgccctggacactcagacacacacaacttctgctgaggctgagcatagaagggtgaacttggagttcctgctcaggaggctcctggggaatcaggccaatgaggtcatcactgtagaagggacaaagctgcaacatatggggcaggactagtttttaaccaagacacagcatggtggcaacagaagcaacaagaacaatcccaaatcccagcctcttctctaggcctggtggctggggcagactgggctctttggatggtcagcctctaggggtccttgggcaatggtgttggcaatggggtggggaaaagtgagaggaaagcctcaaaaaaaagatgccaggcctggtgctgtgtctcacgcctgtaattccagcactttgggaggccaaggtgggcagatcacttgaggtcaggaatctgagaccagcctgccaatatggtgaaaccccgtctctactaaaaatagaaaaattagccaggcatggtggtgcacaccaaaatcccagctactagggaggctgaggcaggccaattgcttgaacctgggaggcggaggttgcaatgagccaagatcgtgccactgccctccagcctgggcacagagcgagactccatctcaaaaaagagatgccagacctccctgctaatatacgcaaatgggtgctcaggcaactaatagggaaaaagcaacagatactttgatttaagcttgcaaaatgagtcaaagctattacgtgaatatgtgtttccaaagaccagcccacgttcaacctgtgggattgagataatagacaagaaagtgtatttgaaaagaagagttacacaggcatgagggtggcaggaactaccaccgattctcccttccttctttgtattaatagatttagtcttgagattaagctgggcttatggctgcccaagtaaagacttcatttcccagcctcgcttgcagcaaggtgtgatcatgtggctaagtctgagccaatgggatgtgagcagcagtgatgtgtgcaacttacagatcacactattatcagtaaatggcttgtcctccacttttcttctgttctgtggactgcattgtggacatggtgctggtgagtgagcagttttgatgatgtggacaacctcattaaaccaaatggccttcccaccttgtactgccagtcgacttctgaccaatttcataggcaaggcatagacttctatcttatttgagcctttgtagtcactgtatttcgaggtgtctgtcaccttacttgtatcttcactaatataaggagtggtgaattctaccaccaagaacattgttcagcttcctgcttctaaagattaatggggaagcaatttgtggttatgactgtcttggtatatttttttccattcattcagcctgtcagtcagtccatcaatgtttaatgagagcttcccaagtgccaggtgctatacaaggggctggagatacaatggcaaacaaaacagacatgggttctactgtaatagagatttctgtctagtggggagagtcacatgaaagaaataatcccacagataaatattgaattacagactgtgatatgtgtttgaattaaaagtacaggatgtgggaggctgaggcaggagaattgcttgaacccgggaggcagaagttgcagtgagccgagatcgtaccactgcactccagcatgggtgacagagggagactctgtctaaaaaaaaagaaaaaaaagtacaggatgtcatgaaaggatatagtagggtcttcatttagttttgagaactttagaggaccttctatgttgagacttaaagaatgagtgagtaggaattaaccaggtgaagagttagggggaagtgttccagaaatgggaacaacttatttcagaggttgatacttcaggcacaggaaggttagtgtggccaaaggagggcagacaatgaggacaatggcttggaccaagtcagagggagagagacatagaggccagaccatgcaaggccttagaggccactgtggtaggctggattctaagatgagctccaagattccttccccctgtgtacacaccctgtattatcccttccccttgagtgcaggttggacctgtgaatataatgggatgtcactcctgtaaataggttacattttacggcaaaagtagagagattttgcagatgtgattaaggttcctaatcagttgactttaattgataaaaaggaatattatcttttttttttttttttgagatggagtttcgctcttattgcccaggctggagtgcaatggtgcagtctcagcttgctgcaaccttcgcctctcgggttcaagtgattctcctgtctcagcctcccgagtagctgggattacaggcatgtgcgaccatgcccggctaatttttgtatttttagtggacatggggcttccatgttggccagcctggtcttgaactcttgacctcagatgatccacccacctcagcctcccaaagtgctgggattacaggcgtgagccactgtgcccagcctggaacattatcttcttgggtggatgaccattaggtcagttgatgtgagccatttaatggaaggcctacaagccagttacaaatagacgaatactgtatgactccagttatatgaggtacctaaagtagttaaaattacagagacaacaatgtgaaagtacttaatgccactgaactgtacacttaaaaatgattaagatggtcaattttctgttacgtgcattatgccataatttttttaaaaagggtctagatgtcagagtcagaagaaccagcagagatgttctctccttgaccttgagggagcaaattgccatgttgtggagaggaccatgtgttagggaacatcaagcagtctttagaggctgagtgtcagacctatagctgcaagggacctgctgaaaatgagcaagtctcagatgagatcatggtccccatccgcaccttgactacagccttgtggggtcctggccagaagacccagtttagctgtgcccaaactcttgacttaagaaactggaattatacatgtgtgttcttttaagttactacatttgtggtaatttgatatgcagcaacaggaaacttatacaccatgctataggtttaaggtcttctacatacttaggaataaatttaaccaaagaggtgaaagatctctatactaaagactataaaatgttgatgaaagaaattgaggaagatacaaataaatggaaagatatccaatgttcatggattggaagaattaatattgttaaaatgtccatactacctaaagcgatctacagattcaatgcaatccttatcaaaatatcaatgacattcttcacagaaatagaaaaaaacaattctaaaatgtgtatgaaaccacagaagacctcgaatgcccaaagcaatcttgagcaaaaaggacaaagctggaggcatcacactacctgattccaaaatatactacaaagtgatagtaatcaaaactgcatggtactggcataaaaacagactcataagccaatgaaacagaacagagaacccacaaataaatctatgcatttatagccaattgatttgcaacaaaagagccaagaacacacaatggggaaagaacaatttcttcaataaatgatgttgggaaaactgaatattcatatgcaaaagaatgaaattagacccttatctcccaccatatacaataatctactcaaaatgaattgaaaacttaaatgtaagacccataactatgaaactactaaaagaaaacatataagaaaagttctatgacattggtctgggcaatgactttttggatatgacgcccaaagaacaggcaataaaagcaaaagttgacagtgagatcatatcaaactaaaaagcttctcatagtaaagaaaacaattaacagtacaagacagcctacagaatgggagaaatatttgcaaactatatatccaataaagggttaatattcaaaatacataaggagctcaaacaattcaatagcaagaaaacaaataacccaattaaaaaatgggcaaaggacctgaatagatgtttttcaaaagaagacctacaactaacagatatatgaaaaaatgctcaacatcactaatcagcagagaaatgcaaattgaaaccacaatgagatatcacttcatacctgttagaatgactgttataaaaaaaaacaaaagataagaagtgttgacaaggatgtggagaaaaggggaacacttgcacactgttggtggaatgtaaattaatacagccattatggaaaataagatggagattcctcaaaaaactacaaatagaactaccatatgatccagcaatcccatttctgggtatatatccaaaggaaatgaaatcagtatgacaaagaaacatctgcactctcatgtttattgcagcactattcacaacagccaagatatgggatcaacctaaatgtccatcaatagataaatggataaaaagaatgtggtatatatatatgcaatggaataccattcgactataaaaaaagtattaaaatcacccaggcatggtggcttatgcctgtaatcccagcactttcggaggtcaaggcaggaggatcacttgtgttcaggagtttgagagcagcctagacaacatagtgagaccttgtctttacaaaaagtcaaaaattagccaggcgtggtgggatgtgcctgtagtccctgctacttgagaggctgaggcggaagcctcgcgtgagcccaggaggtcaaggctgcagtgagctgtgatggtgccactgcattcagcctgggtgacagagtgagaccctgtctcaaaacaaaacagaaaacaaaatcctgtcacttgtgacaacgtgaatgaatttggaggctattatgttaagtgaaacaagccaggcacagaaaaacaaatactgcataatctcaccccctttttagatgtggactctaaaaaagttgatcttagggaagcagagagtaaaatggtggttagcaggggctgtggtggttgggagcagagtggttgggaagatactagccaaaagacgcaaaatttcagttagacaggaggaaaaagttcgagagatctattttaaacatagggactatgttaatagtagctataatagtaaatatagttaatagtatattagtaaatataatagcaataatagtaaatatagttaataagatgttgtgttccttacaaaacaaaaatgatgactatgtgaggtaatgcattagtttattagtcagatttagtaattccacaatgtatatatacttcaaaatatcatgctgtacatagtaaatgcgtacaatatttttgttgatgtaaaaataaaataattttttgatgctcatgatctgaagtctaaaataatactatttttttttttttgagacagggtctcattctgttgcccaggctggagtgcagtggcacaatcatgactcactgcagcttccacctcccaggctcaattgatcttcctgcctcagcctcccaggtagctgggactacaggtgtgcaccaccacacctggctaatttttctttttttttttttttttaagagacaaggtctccctatgttgcttagactggtcttgaactttcgggctcaagcaatcctccagccttggccacccaaagtactgggattacaagcatgagccactgcacccaacttaaaatagtaataataacttttgaaaagaagaaatagaaattgctattttttaaactcttcccctgtgtccaaggagaatccatgaaatagtttacggatggagagcaagaatcatatttgcactcttcaaagattactctgcctgcttcgaggagggagaacatggaagcagcaagatcagttgggaggggactgcaatagcagaggcaagatataaaagaggggctggaactccactggtggcaaaaaatagggagaaatggaccagttcaaaatatcttggggaagtagttggtagattaggagggtggaggtgagtgaaggaagggtcaatgatgtcttcaaggctttgagcgtaatcagctctgatgggaaaccctagaagggaaaacttgttcattggacatgtttctatggattccttactgggaaatcactgtgctagttaagaatgcatttgggctgggcgtggtggctcatgcctgtaatcccatcactttgggaggccgaggtgggcagatcaccaggtcaggagatccagaccatactggccaacatggtgaaatccctgtctctactcaatatacaaaaattatcctggcgtggtggcagtcgcctgtaatcccagctacttggaaggctgaggcaggagaatcgcttgaacccaagaggcggggttgtagtgagccgagatcatgccactgcactccagcctggcggcagagtgagggcggcactccagggtggccgagtgagactcaaaaaaaaaaaaaaaaaaaaagaggccgggcgctgtggctcatgcctgtaatcccagcactttgggaggccgaggcgggtggatcatgagatcaagagatcgagatcatcctagccaacatggtgaaaccctgtctctactacaaatacaaaaattagctgggggtggtggtgctcacctgtagtcccagctacttgggaagctgagcaggagaatcgcttaaacctgggaggtggaggttgcagtgagccaagatcaagccactgcactccagcctggtgacagagcaagactctgtctcaaaaaaaaaaaaaaaaaagaatgcatttggccacaagtaatagaaaacccaaatgactagacttaataataaaaatgtttaattatattataattaatataacaaagacctagaagtaggagttccaagattggctcatgagtttgtggaaacaaaaacttacaagccatacatttttaaactcagctttggctataagagtttaatccaagctcaagcctgcaagtctgaatccatagttattgaagaactatgacagaatgggtgtctaatgacatacatgctttaggaagacaagctctgagtcagccattataagacaaagaaaagttagcaaatatttccatacctattaccaaacaaggtaagttaaatctataccttgtcccccctatttttatcataaaattcagtttccaagtttttttattgagaagggcatagagtttttctgaaatagtgttagttctaatagtaatagtcctaaagatcattgattgacttacaatcttgagaccaggatatgtttgttacagtaacatctgccaggatgtgtgttgtagaaaacttttgttcacacaaaactgcaaattgtgtttggcataggcatttgatcttatctaccagttgaggtgattattaaacctgacttcattgatctcactttcatttactcaccttataaaagaggactgtgcaggttttcttaaatttaggaacatggtgaaaggtattgtcttccttgtaaaatgtaagagtggtgacagcaaatcaactttaaaatataatgcagaggctaggctggtggctcacgcctgtaatcccagcactttgggaggctgaggcaggcagattacaaggtcaggagatcgagaccatcctggctaaaatgatgaaacccctgtctctactaaaactacaaaaaattagccaggcatggtggtgggtgcctgtaatcccagctactcaggaggctaagtcagggagattcacttgaactcaggaggcggaggttgcagtgagccgagatcacaccactgcactccaacctgggcaacagagtgagattccgtctcaaaaaaaaaaatacaatgcagaatgaaatgggtcacaaccactcaaccatgccagggccctaggtcagccctctgccaatctctaggcatgccagtggcagcaaggtgactgccaagggaagaaggggatggacctctccctatggatgtaactaggtattttcccagaagctacttacatgccattgataagggtctggccagtcaagagcacaggggctggggttgctatgattggtttaggccacttatagctgaacatattacagcctgattgaaactggggttttgtcagtaggggaggcagagcaggcagaggggctgcaaagtagggagtgagatgtcagacaactgcctttgctgcctccccctagtccccattctgggagcccactgtagaagacacagcgggcggtaggaaacatatgtgaaaaagctcgatttttacaatgcaataaacattaaacagctttgttggagagcaaggagcctcataaagtgagtcacccaggatccttctcgcaggactggggcatgccaaagagcaggctttgagtgtaggtagacctggccgcctctcagtgcacctctgatggcaccagctcctgggcagggagctgttcccccagggcactggcatctgggcagggccaaggaagtcctcacctctgtgactctgctcccaggcactcgacatccttcttggctgggaaagtgtgacctccaggaaaatgctggggacgtgcagaggccagcgccctctgcatgggtctcctgggaggcctgtgaggggcctgggaaatgatcacaggcttttcccagccttccttcatccttgggaaattcgctgaaggccagtcccctgttgagtgtggggctctaggccctcttgggtcctgagcagagctgggccccactcctttctctcccagcagtgaccgtaagacactgcccccaagtgaggagagggacccctgtgtgaaccggctgcaggaagcccttgctcctttctcaaggctgcgagccaaagagagcaggctcctggggctgtctcttcactatccagtccagccctaacaacctactcctgcttgggtctccccgccccctaccctctgccctgtgctcccaccatccacttcaggcgaaagggagagtgtgctgtcctgtacatgctcacacattcctgtgcctattacctggcccctcacctggaaggcctgtctttgatcttccacctagacagagttgcccccctctggccctcccaacatgcagctgacccaggatggtcctgcagcccacaatggcctcgatgagcacatctcacagggctaggtagggggcactggcagaaaattagcacccaatggggagaggctgcagcaggaccagagcaggagcatggccagggcaggatgcccacctgcagccgtccccagggggcttggccatgtggcatgcgctgctggtggaggaagcttggctgagcatgggggcaggggaacaggcccccacacacactcagatgcacgtttacaatcacatgagctgcattctaacagctagtgtatgtcctttttattctcaaaaaaatttttttactgtagtgaaatacacataatataaaaatgaccatcttaactatttttagctgtacagttcagtagcattaagtacattcacattgctgtgcaactctcaccaccatccatctccataacccttttcctcttgtaaaactgaaattctatacccatgaaacactaactccccatttccccttctcccaggccctggcaaccagcattctgctttccatctttatggttttaacgatgctaagtacttcagtcttgaatacttttctccattccccacagcaccccgctccccagtcgcagacacccttgcctgctcttgatttgcctgtgacattgcagtggttaacatgggcccccttgcctccagtcagaaggcaaatcaatcccttccctgctctagcaggattggaagtcactgaacctatttgcttctcattcaaagtgatggcagccagagggtggtgtggcagtgctgggatgggtggggtgcaggcagtggagatggcaggaaggacaaaagcctcagctgttctaggggacagtggcaggaagagccgcctgtgatccagacagaccccagtataggcatctgcgcagcatctctaagacagatgcagcatatcccacacaggaggaggaaagagaagggtgaacccttcacgagagactttcaattgtctctgatggctcatccctacctcacagcctgctgtgatgcttagagttctctaggcagccatccctaattgagtataatggactgaatgtctgtgtcccccctcaaattcatatgttgaagccctaaccctcagtgtggatgtatttggagatggggcctctaaggaagtaattaaggttaaatgaagtcctagggtggggtcttgatccaataggattaatgtccttctaagaagaaacatcagagtgtgccagcatgtgctcgtgctctctctcctctcttctctctctgcctctgtctgtctctctctgtctccttgtggaggaatgaggaagggccatgtgaacacacagcaagatggcagcttcctataagccaaagaaagagacctcagaataaaacctaccttgcgggcattttgatctcggacttctggctgcagactgtgagaaataaatttctgttgtttaagccacccagtctgtggtattttgttacagcaacccaaactggctgagacatcgaatcatcatgaagccacggggcaaaggcatgggagtattaacaggcatagcttgtatcagaaacggggagtagcatggtgtgtccagaggccatggcatttagagaggggtgtaactagagatggaatcagagagctagagcctctatatcatctatggcaatgcaggccatgccagggccttgggacttaccctaagagcactgaggaatgatcttcacatttgcatttagaaagagctatctgactgctctgtgcaggcttgatcagtagaagtggggaggagcagtggaaagggtggggatgaaggggcaagagatcaagaggcagctgttccatggatcaaccatagggtagatgtgggccatgggaagggatgggcctggtcaccaattagctgcagatgaagaggcagtttctggcctggatgatgatgagttgcacaaatagttctccccttgacagagacgtgattgactcccaagcctgggcaggtcccaggttccaaacagaacagaagtccctgaatcttatttctaccacattcagttggtcaaagctagtcacaggccagcccagattcagtgctggtggggcctacctgacggtgtgaatacaaggaggctcaagtcgctgggatcatttcataacaccccaccaccacatccaagttccagacaggaagaaagggaaaaacaaagccaaaggccagaagcacttgccacctagctaggcctatccttttgaacaagctttccccgaagtctcattcagtgccttcctctggtccagagaaagaaatgggtcacatgactatccctagctgcaagggagtctgggaaacagtattttaacctgagcacactgacaccaccaataaaatccaaattctcagtaaggaagaaggagaggatagatctagaggaagcaactagcagggcctgcttcagaggccatggaagagttggggggaaccaccaccactaagtgcttttatgggagagaagccatgctcagcatgcaccaaattatgagaaaatggagaggctggttcattaggtctggggtggggtccaaggtgtgcatctccaacatgctcccagggctgctgatcctggcagtaggaagatcacacttggagtggccctaaactgggttatactggggtcacaagcaaccccacatgtcagaggtttaaatagctgaggtttgttccttactcatgcagcctgtgcactgtgagttggctggggctttgcgcctgggagccaggtggccagagcatctaccatctggagcagcactggtgaccaggccagagggaaagaagtcattcatggcaaagaattaagcaactcttagaagtcattcaagtcaaatggccatgcccaacatctggcagggaggggaagccggtactggtgaaccatactacagactatgacagcttcacagaagagatgggatttaagcagaggggtctttgaaggataaataggagcttactctgtagagaaggggccagaacattcgaggctgagggaacatcataaataactataacaccaatgttgagcacctgtcgtgtaccagaagcattcaaatcgtttcctgactggtcttcatgagaacactgagatattattagtccattttatagaagaggaggctgggggtctgagatcagctggccacttgctgaaggtcacagggccagaaagtggggcccaggaaatcaaacccagtgtcctggcccttccctcccctgccacagtggagtcatggagcctcgtgactgtgtggagtgtttgcagaataatctgtgtgatgctctttctctggaaatggccccaacacccaaagggttttttgggggtggatggggaattattaaggggttgcaatatttttttattgtggtaaaatacacacaatgtaaaagttatcattttcatcatttttaagtggcatcattttaagttcagtggcattcagtacattcacattattgtgcaaccatcatcgccatccatctccagaactttttcatctttcataattgaaactgcctccattaaacattagttgcctattccctcctcaccccaactcctggcaaccacaattctaatttctgtctttaagaattggagtgttctaagtaccttatatacatgaaatcatatagtatttgtccttttgtgtctgactttttatcttagagtaatgtcctcaaggtttacccatgttgtagcgtgtgtcagaatttcattcctttttgtggctgaataaggttccattggatgtatatacagtattttgtttatttatgcatcggtccatggatacttaggttgtttctaccattttggctatcgtcaataatgctgctatgagtgaacaaatatctgtttgagtccctgctttgggtccttttgtgtatagacccaaaaatgggattcctggttctagaggagtttttctgtttgttttgtttttttagacaaagtctcactctgttgcccaggctggagtacagtggcacaatctctgctcactgctacctccacctcccaggttcaagtgattctcctgcctcagcctcccaagtagctgggattacaggcgcgtgttaccatgtccagctaatttttgtatttttattagagatggggtttcaccatgttggccagcctggtctcaaactcctgacctgtgatccgccctcctcggcctcccaaagtgctgggattacaggtgggagccaccgcgcctggcaggagttttaaacatacaagacaaaggtgcctgtgggcttcgttggggtctgggaaaatgctgcgcaggagcactgcaggaggatgccaggccctaggatgtcctagttcatctcccttcagctggctctggggaggaggatctgtgggagccccgcatcccatccaagatacacaaaacttctctgccagttgtttaactgcttcacaggcacagaccttgtccccaaggagtcggaatgttctcacgggaaaacagtcgataacacacccgagtcttcctttccttcatctataaaacagaggtgctggtgtcgcccgcctgcctcacagacagttgtgaagtttgaatgaactaatgcctgcaaaggatgcagagagaagctggaggctcattctgcacctgctgctgctgtaggcctgccacgcccagcccgcttgcgggtcaaactggggcgctgacaggagctgctgtctgcagaggctgggggcctctggggctatttccacaaacccaggagagttctggggctgaaacagctaaaaagagggcagaccagaggtaagatggcttcctcatgacagttctagggccgaggttctcaaactggagcatgagtgaaaatccccctgatagtgttcaaactcagataacagcctccaccctgcagtttctgactcgggagtctggggtgcggcctgataatttgcattgtaacaactcctcctcctccggctcctcttcctcttcctccttctcttcttctttttttgagacagactctcgctctgtcacccaggctggggtgcagtgtcacgatctcatgatctcagctcactgcaacctctgcctcctgcgttcaagcaattttcctgcctcagcctcccaagtagctgggattacaggcacccaccaccacgcccagctaatttttgtatctttagtagagacagggtttcaccacattggccttctggtctcgaactcctgacctcaagtgatctgcctgcctcggcctcccaaagtgctgggattataggtgtgagcccccgcacctggcctgcattctaacacattcttaggggctgccgttgctgcttacctggggacttcactgtgagaaccactgctctagaaaatgaaggagaaaaagatgttcatttttgaggaccgtggacacatggattccctcctccttctcttttttccctttccttccttctttgtccaatatttaattgagcattaaaattgggactacagagaaaaaaaaaagacagagtcttggcctataacagagagtctagagctgggctggccagatggtcgccggctgcccagggacccagcctgctgtgaccggacgcggaggaatcccaatgagtcagcctgcaggtggaagggaaacaccgtgtcccaggccaggggccagggcagcttgccaggtcctgtgagagcccaggcagagcccgggcagccctgtccctggggttgggtggtccccaggcggcaggacgctgggtgaggagccggtttgtggaagagcacctgcgacagggctgtgcccgcccaggccaggccttcagaggccacgatggaaggtggatgagaagtacagtgagcaggacagacatcctatgggcagtggaatggccttggctcaagttgttccatttccccttttcaatactctgccccccatgctgagccccgcaggctaccttcccatggatccaccctccaggcttctgtagccttccattccctccctcaccgacctggctttcattcctcaggggcctcctattttcaaaggagagaactagccactttgatcagcacgacctaggagatgtcaccctacaccagtcagaacccgaggacgatgccagaggtgccccacgcaaaggcacatctccaagaggggcagcagacctggcctccccttcaccactagatccatttcttcaactgtgaaatggggccaacaggacatgtgtcgccgggctgtggggatttgatgagatgatatcacaaagaggttctttgtaactggtacagtccatagccaggtcctctccgcaggaaagccccaaggctggaagatccctttgggttaacccaccactatttcctcaaactcttcaatattgacttgtgctttgatttgggccatcacttgggagtctcagttccttaaggtgactgcttgttattcatttgctctaatttcatctcttgtgagctgccagctccccaactagataaactgcagaccccaccccctagtagtctcgtctgtacctcctagagacataccttagaagaggtgttctggggcctggagaggcatttggtgccctcacatctacctgccataccacatgcagggcagcctttaacaaagtccaatcctcagggtctgtccaagcaaagggggtggacacagagaggagattaaggacccagactctggagacacctgcttggcttcaaattcctgttccacgacttgatgactatgtctttgggtgagttactgtaagacgaggagagtcaccatactccctcactgggtggttgtgaggagtggatggatgaacaggtataaaagactggggccagcctgcacctggtgagctccaggtcaaagtgagcccctgcatttgtaagcgagccaagcagaagccacgaatgacggcagggctgcttcatgttgctcctgatttctggtaattttctgctcttaccacagtcccctccagcacaactggacatgctgctgtaagtgtagtcttcttatccatcacaataggtaatttgcctttttaaaaaattttatttttgagacagagtctggctctgtcacccgggctggagtgcaatggcacaattttggctcactgcaacctccacctcccaggttcaagtgattctcgtgcctcagcttcccaagtagctgggaccacaggcgtgtgccaccatgcctggctaattttttgtatttttagtagagacagggttttgccatattggccaggctggtctcaaactcctggcctcaagtgattctcctgcctcggcctcccaaagtgctgagattataggcatgagccaccatgcccagctgtgctttttcaatcaatctatgtaccttagaaaaggttgcagtgagccgagattgtgtcactgcactccagcctaggcgacagagagagattccatctcaaaaaacaaaacaaaacaaaacaaaaacaaaacaaacaaaaaaaactgctccagaagccctagccaaagtctaaaggcggccactggcctgggtggccaagagctaacatctttactcaaggttttacacaatgcagggactgtgctgaattctttacctggcttgggagaaaaatgtttagcacagtgacaaaaggttatctatatctatagtaaatacaattctttaaaattgacaaaagcaataccaataacccaatagaaaaatgggcaaaggatacaaataggcagttctcagaagtgcaaatcagaataaccaataaacatgtgaaaagatgcttagatttattaatagagaattgcaaactgaagtacaaatgaggctgggcatagtggcttacacctgtaatcccagcactttggaaggtgaaggcagcagatcgtgtgagctcaggagtttgagcctgggcaacatggtgaaaccccgtctctacaaaaaaattaaaaaattagctgggcatggtgttgtgtgcctgtagtcccagttacttggaaggctgcggtgggagggttgcttggtcctgggacttcgaggctgctgtgagccgtgattgcaaccctgcactccagcctgggcaacagagtgagaccccgtctcaaaaaaaaaaaaaaaaaaaaaaagatgccactgcttcatctatcagaatggctaaaatgtaaatgattccactttgtaaaataaacaatgttaacccgcatctatgtgtatgtggcagggtttcctcaacctcggcattattgatatttggggctggacaattctttgctgtggagactgtcctgtggactgtagtttagcagcatctctagcctccactccctagatgccagtagcacctccctccagtagcaacaaaaaatgtccgcagacactgctgaatgtcccctggggggcaaattgccccaagttgagaaccacttagtgtataggtaaacatgtatagttgtgtgcaatttaatgaacacaattaattttaccaccattttacataaaaggaaactgaagtgcatttcttagggtcccactgtaagttgagggcttgagattccaagaaaagtcttatttcagagctcagtgtcttgcccaaaacgcagcctcactgctcaatcacattcttgaggtttgattggctgaacgcacgtggaacatcaggttcatgtttccaagcaagaatcatgggttggggaaggcaagtgtttactgtggtccagctgaggactgtggtgtctgaaactttgtcacatgggaggctacaggcccggggctggcttggctcccgtgaaaacactgcagcgggcagccagtccggaaggcagcatctggcagggcctccaggccttctgagtaaggaagaccccagcttgcaaaagacatagaggcagcactgtgactggaactgaatagccacacctatatcacccatattcaagggcaaagggccagcagccagggtggaagtgggggcaggaggtggggaggggatggctggactcctgattctttttcagtttccctcccttctggctgttgaacacccaagtacctccccactgtcctctccactctgtccttcctacaaagcaccctctagagtgcagccagctgggcaaggcatggtcctataggggacagtgtgcatgtgcatatgaagcctgctgggtacctcaacctttggcctgatcatgaagacggtgaactggcttgtttggggcagaagactacaagttctgtgagggcagggcccacatagcttgtgcatcttagggtgcctgggacacagtggagatcaaggttggatggatgcagcatgggggagggaatggtgaggatgggcatggtcaggtatctgtcggctgggacaaacctcccaggccattgagtccaacttgcgcgaagatagtcactggggagctgcagtgacacctgagcctgtgaataaaccaggtcctatcagggggcagtgtgcacatgcacatgaagcctgctgggtacctcaacccaggcagttacccaggtaccctgccgggtaactcagagttgagttaaaccctgctccttgatgaccactcgtggtaggacagcgatgctgcttaaagaacttaaggaacgaatctgattaaataattatgatttagcattttaagtggaaacctctcatggagctgcttgtaggaaacgctggctggctgagttccctccttctgcccctgctggacaaatggcctcgcttgctgtgctgggctggcagagctgcaggcctccaggtttctgctggaagcatcatccctttcttctttcaggctttgttgagccccaggtggagctgatggtggcatcctttggaccccactgtaaagtccttgcagacatctgtcatggcacgatgacagctttactgcacgtgcactcacttgagggcagagatcagatcttaagatcctactgcagaaacctagggccagtgactccttgagatgtcatcgtaccgataggtggtgacggtggctgtgcatttccacaatttagggctttttctgtccgtggctctcaattccgctgcaccttagactctcttgaagattttctaatgcctaggccacactccaggccaataaaatcagaatctgggcaaggccttgggatcaatctttttttcagacggggtctcactcttgtcacccgagctggagtgcagtggtgcgatcacagctcattgcagccttgaactcctgggctcacttgctcctctcacctcagcctcttgagtagctgggaccacaggcacatgtcacaacacctggctaatttttgtagatacggggtctcactgggttgcccaggctagtctcaaactcctaagctcaagtgatcctcctgcctgagtctcttaaagtgctgggactgtaagcgtgagccactgtgcccggccagaatcaatctttttttttttcctaagacggagtctcactctgttgcccaggctggagtgacataatctcggctcactgcaacctccaactccccggttcaagtgattctcctgcctcagcctcctgagtagctgggtgaaaccccatctctactaaaaatacagaatcgatctttttaaaaagctccctaagtgtttctaaggtccaaaactgagagcctctaagtggactttggacggaagtggggtggaggttgatggtgtaggaactttggaatttttgactgtagctattttggtggttgtaattgaagtaaaactgcaccagggtcaggagacctgcggtaggcccagcaactctgtgacctatctaaactacacaacctcaagggcaggctgtggtacggggctgccccactgagccatctgcagaggtggtatcactcaacgatgaaagactcaacgaaccagcctttaacgaccagtcttttctatttcaagagcagtctggactctgacagcccctgattcaggtgcaaactaaaaattttaagattggcaagcaacagacactccttaagtggttcctaactctccccaggtgcagaacacttaagggtcccaacatctgattgaaacacagcccacaccaaaccacgagatggcacctcatacacattagggtggctactattaacaagaacaaggatgtggagaaattgaaattgttgtacaccgttggtgggaacataaaatggtgtagctgctgtggaaaatgggacagcagttcccccagaaaaattaaagaattaccatatgatccagcaattccacttctagtatatattcaaaggaaagcagggtctgagtttttgtttttttttttttttgagacggaatctcactctgtcacccaggctggagtgcagtggcgcaatctcggctcactgcaacctccacctcctgagttcaagattctcctgcctcagcctcccgagtagctgggattataggcgcgcaccaccacacccagctaatttttgtatttttagtagagatggggttttgccatgttggccagggtggtctcgaatcctgacctcagatgatctgcccgcctcggcctcccaacgtattgggattacaggtgtgaacgcctggcctggcctcagatatctgtatatccatgttcacagcgttatttgcaacagccaagaggtggaggcaacccaagtgtccaccaacagatgagtgattaaacaaaatacggtatatacacatgaggaggtatcagcagcctcaagcaagaaggcaattctgacacatgctacagcatggatgaaccttgaggacattatgctaagtgaaataagccggtcacaaaaagacatgctgtacttttccacttgtatgagggacctagagaagtcaaattcgtagagacagaacgtagaacagtggttgccaggggctggggaggtggaaggaatagggagttagtgctcaatggatacagacatttgtacatattatttgggggtagggcaaagtgaagagaaaagaaggttcaagttccagactggggatgagacaaggtgcttcaccccttcctcggttttattcttactcaatgcaggatagaaaatgtttcaaagactcacaggaatatctgtgggaatgctgatagtgtttctggtgagaacccaaaaaagagacactaaaaaaaattaactggccaggcacggtggctcacaccacccagcactttgggaggccacagtgggaggaccgcttgagcctaggagtttgaaaccagcctgagcaataaaccaaaacccgtctctacaaaacaaataaaaaaactgttagaagcaagcaagtaggtatggatatcaccccaaagggcaaggtgagaaggatgtccaaacagtggctagctaatggcatctgaggattctgaaagaactcatagctctggccggcacagtagctcacgcctgtaaacccagcactttgggaggctgaggcaggcggatcacctgagattaggagttcgagactagcctggccaacatggtgaaaccccatctctactaaaaatacaaaaattagccaggcgtggtggcgcatgcctgtaatctcagctactcgggaggctgaggcaggagaatcgcttgaactcgggagatggaggttgcagtggagccgagattgcgccattgcactcagcctgggtaacaagtgcaaaagtgcatctcaaaaaaagaactcacagctctcatgaaaagtttgtgaaccccaccagatgatcaatctccattacattttgattaaaaatgacaacgcagattagtccatgttcttgaatccatccatcagatttgacttgggcctactttccaaaactcaaatgcatcctcaatgggcacttacagtcctaagaagactccaaagcctctgccatcttaagctgccaaggccactctcagaggcttccgagcatagagaaccaccaaagtgagcgtgtaattccctaaggccaccacagtgagtccctgctcatcaggatgtgcaagctcccaaatgtctgtttaaaaaccagacatgctgtcttaatactcatccatcaggaaagacacaggaataaaacagagctgcccaggaaccatgtggatgggtggggcaggagggcatccctcacatcccaacacaggtcgggggtctgatctaagtgcgatggtcacagccctgccaatatgcagggcttgctccttcgcctctgcgccctcagtgcctgggagagatggaatccacggaccctgtgccacagtcaccaggttactttgtgatctccttcaaggacactctcacaattctagtgtgtgtagaaatcatcaagtgaatatggcctttaactcaaagaatgaatgtcttaccctgcaggctgggcccttcctgcctgcctcaaaactgtcatattcctctgtgcccatgccttggtgaacctggcagaccccgttaggaggtactgatttctgtcaggctttccccagtgtaggcctaggaggtgcaggctgggtcctattgcatggatgtagggagcaacatggtcactctcccttgacaaagcctcccttgatccccaaccctacccctaaggtcacagcagcagcctccccaccccagaccaaggctagcacagcttctgcataaaggcttctcccctctgcttctcctggccacagggccagcagctagctctggaaggaggtcacagcagaggcaggccaggggcagaggtggaggaggctgcagaggctgagctcttccccctaaggcctcagacaagaaagcacaggaagagggacccaagacctgactgtgccaagaaaatccccgccctgggttctcaaatccaaatgcagaaactgcaaaccaagggaaaaaattgttgtaaaaaaaaccaagttttttttctttcctaatagctagttccaatgatgttaattacccgccctgagctgaaataacagtagacaaagatagaagctagcctctggttttacaaagcctttgtataagtcctctctgtcttttctgtccatgccagggaaatgtattgctggtgctagagggagaggaaacgtggacggccaagaacagggcggcacagtcctctgggctggaggcctgtgttccttcccataagcagggcctgtggggtgtatggggcagaacataggcctccacaccaaactgacagcagagaaaagccaggcaacctgttcaatcgccccagcagtgacctgggttctatgtgtgggagtgaactgctgcggccctggagcgactgctcccagccttggggctgatgtggtctagaaggacacctcgccacacagtggcagggccaggaccctggccaggcagagaggttgggtgggtggaggactatgctacgctgtacttgactcagggaagaagtcttgatggggactctttgtggactctgcccccaggggctggagcagccggaaggagcaggccttgggcagcaggctccacgttcctgctcatcgggagcccccaggaatcttgtctgttgtccctggccactcacagcaaaagaaccccgcttccctactctggaggtgcctggggtccccagcagcaaagcatggcttccccttggtcttctcagtgaatcgtgaatcaggacttctccttaggggttatgccacagaggcctcctgcagcacaggtgaggccccagccatctcagggggactcagaagacttggtaaaccttgataaaaatccagagacagggaggggcaaggatgagcaactctgtcactttccaggtgaagctggcccagctcagaggcccactgctttcaggcccaaggtcgctgctgtgctctgtactgtcacttggaactgccctggattccagtctcctggtcctctcatgcagaaggcaggctgggccacgccctcaccaagggtccttggagctgggcagatggtgccggggtagctgctatctcagaggctgcttgagctcgaacaggcctgtcccgcccctgacgaccttcccgaccacaaggcaggcagaaggagacctcagctcatcgtgggatcctgacagagacacaaaaacatgtgtcagggtgttgaggtagaagttgggaatgtcatgaggtgattatggggctgaacactgaagtctcgggactcaggtgggtcctgagtctctgaagctgatgggatcacgaggcagcccccctctagcacttgagaggggaaggccctcttcctgttccttcaaagcgtagaggcagctgtcgtgtctgctgttcagccccctccagccgcccccgctcccctcagatcccaagatcccactggtgtgcaaggaaccatggaaagatgcccatgggtgagcccgtgtgcccagagtcgtcagtagaggggaggccagggctcctgcccacgcactaacccagcatggtggcttgcttcagaaactggaagctggtttcaaatgtcatctgctgtagcggggaagagtttgaccggatcccaaagcgattcagtggcttgtaaacaccctcgaagcacatataatcagcaaccagggagagatggcgagggtcgaccgcgatgcctgtcaaacgggaggtaaaattaggagggattaagcagtgaccacgggagcagtcagcagacacaagccaagctgcctccacatcagcacatggcttgggagttagactctggggctccccttcagctccgccacctgctcacgctacttaacccttccccgtggtctggggcatctttccctgacccctgcatcctgcttcccgcttccttccagcagcacaggaaatgaggatctaaccgcactgttttcacttgggaactgaaaccccaaaggcaggatggggccaagttatcaatcaggagctttctctaaggcaccagcagatgagacaccactgaagcggtctcagtgatgggagacgtcacctcttcacagatctgcagtctcctacaggtgcactcactgcacgcatgctgcagtgcctgccttagtgctggactgactcggtgctggaccgacacggtcctgaccctcctgccgagccttctggtgtcctggctggtgcccagacctcggggtgttatctgcaagctccccttaccatacacggcaaacacatccttgatctccttctcgatcacccgcagcgcggcctcaatgccatacgtgttggctatggcgtggatgtcgttggagtagaggcggcgcagatccaggacctggagagaggaaggaagggatttatttagagggcctggccttctgctcccttctgcctgcgtatctccccctggccgctctctctctccttgtgtctggcagctcggtacagctgatgacaaagtggtcaagaggtggcccaggattagcagaaggaaatggctaggcagagctgctgacggctcgctggccggggcccaaggtctgtatcgtcattacaagaatccagcgtgtccactttggacacgctttagattcaatgggaagaaaaggattttttcttcttatttttaaactgagacctgtttactaggattaaggcttcccttaggaagcaaggaaagttcccctagcagcgacacattacacacccctccagggtgcatggagtgggggccagtcagccgcacaggcatgtgctgggccttaccaaggggccaaggtgcggctgagctgtcttggaggagcctctcaccctgcactcttggcaggtgccaatcctccttgctcatcctctgggaagtgtttggtaaaagggttcaggggagcaggagactttgcagggtggtcattggtgggggcagaagtgtacgtggcagggggagctttgccagcttagcatagacttgttggggggttaggctagagggccccagttcctcagtgttctgtgggggaaacccagaaagttctgggagagttggtgaagtgggagtacttggagacacagctcaaaggacagatgagctggtgagcaggtgggacaggaatgccagggcacctctacccctgggaccccctttaccagataaagcaaacagcatctaggcaggtgatgcagcaatgatttctcacaactctacttcgggagggtcttaatttctttctttttttttttttttgagatggagtctcactctgtcccccaggctggagtgcagcggcgcaatcttggtttactgcaagctccgcctcctgggttatcgccattctcctgcctcagcctcccaagtagctgggactacaggcacccgtcaccatgcccggctattttttttttgtattttttagtagagaaggggtttcaccgtgttagccaggatggtcttgatctcctgacctcgtgatccgcctgccttggcctcccaaagtgctgggattacaggtgtgaaccaccacgcccggcccgagggtcttaatttcaaggaaaaaactctactcaaattaacccgggcgactctgggttggataagttcagcagggtgctttactggggacctgaatgaggctaacgtgccccagaatccccgggaggcagacgaggacacgcacacttggtttggggaatgtggcctggaagcacaaatggctcaggaagggccagagtaaatcgcgtagagcgagcctcccagtggctgggtcttgagacaacgtggggtgaggactaatgctttgtcccaggccagcagacagcctgtcttacctctgcatacttgaatagctctgggaggttgattccttctgtgtttagcacaagctccttctcgttcttattgttggttgtttcattcaggaggcaccgagtgatgcccttggtcgcatagatgacggcaccatgggccaaagatactaccagggagctcatgtcaaagttgatcttcatcagagggagcttcactgtcacctgcaaaaggagggagagctgggtagggtgacagctactccagtccccacaaagaggactgaggcgagactccttcaaaaccttttcaggaactccctggctgggggaaagtggtcctgctgggcaagccagcaggtagtctgaacattggagatggctgaactgtgtacaggtcagccatctccagtcccccagattcagggggaaacagtggggttgttttcacagctgtcggtgacaacattgagattcacatccactctgcactgctcttaatgtccttaaagaccacaaggcagggtacacgttgtttcacgcgtgcaatcccatcagtggttcttgttattaccccatcacttgggaaccactgaactggatcaaaggaaagacaaagcgtaagtgtgtgcacatgtctaggcatccagatcatccaggctttaagggaaccatgaaatccctaaaaagatggtggcaggggctgtgtgtgtggggaactgaagtgtccctgcctgagggcacgaacagtgtctctacaacacgtgtggtccatggtaacatatctgttgtactgaagattaaaggaggtggtgtatttgaaagtacctaaagggcctggtagatcagtcttgtgtgtcttgaaagatcggggagaactggcttactaggggtttgaaaatgacacgtgtgggccctttttcggggcagagggtttatagccatcaccagattcctaaagggatctgggattaaaaagaacaaatgactctcgcaggccccaaacaggaggcctggctgtgctctgagtgggagaccatggggaatgttggctgccccctgcccagctgtgcaggggagctcagcaggccccttccacagagggatttggccagctggaccaaccacccaagccctggcctgcacggccacactgacctggcaccacaggctctcctcggtgtcgtactggtagtcatctatgaacgggtggatctcacgcacagcctggacccggcgctccatggcctcgggcccctggggctcctggctgtgggtgggtttccggggctgcgtcaggagggcgggaagggacgggtcctcctcagtgcctaagcccacctcttcatcttgctcttgggtctttcgagcaccttccctgtggggatttcgttcctcctgcatgtcttcatcgtcgttctcctcgccctccctctcctcctcttcctcactctcataatcaacctggcagaaaagggagcacaggctgtgtcacttggggacccaccatctacctggactctgcctgtggaacaaagacccctgcaaagccttggctggcctgggctacctaggccccacctgctccacactcccggctcctctgctccggcctggttggtctttcttcttccttttgccttgagaatgccacctctctgtccccctgagcccctcacagaggtggagctcaccctcactcagccctcactggtgtacctgctcaccggtaagttccctcggccattatgacagcaggagactggtttgtgggaggagagagaggtatattttcattgtaaaaaccagaggcagcctgactttttcttgccagaagcctgtctggatccttgagtccgatttaagtccagggatggccacatctaaaaggcagccctggagtggacctgtgccaaattcccaccctatgaaccccatcttctcaagagagaggtatgctgggcaggcaggtgctgcttcagggttccttgtgggttcatgacacagaggtgtggcctgggtgccgggagataatccctccaggttaacagggaagggggctgggaccacagctccttcaccccacacagggtctctcacctcctcctcctgcttctccttgcgtttggcatcagaggcatcggcgtccccctcctcagcttcagcatccacaatgtgcccctcctcttcctcatcaccctcctgctctccctgtggtttgtgggcaaggaagaaaaagattaactccaatatctagtgctcagtgaatccatccatccacccaccaacccatccatccatccatgccccacccttctaaccccttctcccatccagccaccaccctccatccactgccacccaacccaacccgtctactggcatctactctgtccagtcccagaacccaggcctccttcccttcagtcttcatctttacatgcaccacttacttgcaaagtttcattcccaaaaattaaaaaaaaaagtgccaggacttgctttcttagaagaagatggtgtcaaatattgttccaaatatttttgatcaaacccagttgcaggtggggatgagaaggaagggttatcttgtagaatactgagtatctcttcctttctcctcctgaacttggctcctagttttttatactctccttctgggtgaattaagaatcaagaccaggcagcattctaaagatagtccacacccgcttgtgcttgagtgagctagcaggtgaactcacggagcaggagagacctagcattttccctggtgtaggccagcccctcattttaggggtgagaagacagacccagagaagggtgacacaactgagaccacagagctggttgggggtagtcccagtccacatcatccccaacccaagcaggctggctgctggctcagatggcacccagggacctgctcccacaccaccctcaggtctggcctgctcctgggtctcctggcagatatctgattatttattcctggactattttgctcctactggttttttccctcttcccctttttgtcactgcagcccaacttctctgcttccagatacctctctggtccctgccagtgccctggtgggcctcagttcatcttgcctgggcaagtcgaaggcagagccaaaggaaaccggaaaaagaactttcaaaggctcagcgcacgccatgacctcgagtccctcctcaggatgaagaccacttacagcgggctcttggagagcagagctatgatgcggaggcctgccccggggctggctacaccatgctgcctggcagcctcgcttgcctggcccatcaggccaagaagtgaatgctgcttctgggctctcagaacagcaggtaaaagctgagataggtaggagatgggccagcaccaggatggggctggaggagcacagagaataggcacagagcctgcccagtctgggggctgtccctgtgcaactctagtgacccccggggactcactcacccgactcctccccaactccccagcgttgtccagatcccgctgtgtagctcttcgagtgtttacgttcctgaaagctgatgctttattattcttctttttgatggattccatcagaagtttaaagaatctaaaacaagaagaaagccaaaaagccctgtgcagtaccagcatgtccagccctaccctcatttgggggataggacgctgagggattcccacaggggatcagtgcacgagatggaggcccagcctctcctagccactcacttgtccctacccgctgttttggaaccgtctctggcgtatcaggaacaccggttccacagtccaacaggcctggtctcaataggtgcactgccactcccggggtatgagtaggacaggcagcttcctcagctttaagccccattgtctagaaaatatgggaattactacgtattctgcaatcttgtttgctaatgatgagaaacaaccctatgtctgattcctctcacagcgcctggcagagtgcgtgcttggtgaaggacagttgtaggtgccgctgtggtcgtcctctaacaaggaaggcagaatctactgtaggagaggggaaccccacccaggactaggaccttcccctgcccacaacctgcagcatctccagaaggtggtgttgctctggccagagaactcccttggtgtgggagccccggcaatgtgacgaaagaacgaggacttcggaagggctcatcaaaatttcgaagggcagagataacttagcttgtggcaatgaatcgtgtcaacaagttagaaccacaccaatttaaaagaaccaacctgaagctcagaacctggccccctgccacttcctccagagccatctatttttagggcctcttaggatccaccctgtcccctccataccacttctttcctcatgtaaccccctgcctgtcttttccaacaggccagaatagcacaccaaaaagggctgcttgtgactgtgagaatcgggtccctcacacatccagccagccgtcccactttctctgagcgcctatactgtgcccagcatgtgccagccctggtggcaaagcaaggacgaaaagacagactccaggccctcaaggagcttagagtcttcatttgaaaaagtaggcaggtcaaatgtatactattttgctcattaaaaacaaaagaatgccactcatcttccctaatattattattattagttccccccaccgtcccgagatggagtctctctatcccccaggctggagtgcagtggtgcgacctcggctcactgcaacctccgcctcccggattcaaacgattctcatgcctcagccttctgagtagctgggattacaggcatgcaccaccatgcccgactaatttttctatttttagtagaaacggggtttcaccatgttggccaggctgattgtggactcctgacctcaggtgatccacctgccttggcctcccaaagtgctggaattacaagggtaagccactgcacccagaccccaatattattttttaactttttaaaggtgtacgtggtttgcccttggcagaaaaaaaagccccctcatccattaatccagagaagagcttgtttaccaggcactggggacaggaacaggatagccagatgagagaaggccgggcttgactttagaaagatacaatcccactggaaagagggggtgggagagatgtttctgtaaggacaggttcaggttaaagtcctgacctgccacagactggagaggagggccttgatctcatctgcaacatgggatcactctcactctgcacccgaggctactgtgcagagcagaggagatggaatgaggcggagtgggggtgcggggctcagctgctgccacacacagggctgcttccctcagctgggcgccccagcctgtctcaacttgtggcaatgtcacggctctgatgcttttgcccccagcatttcacatctggcctcaactctaactgcccatctgctccctccaccctgtgcaccctttgggcctttgcttgagcggctcactctgccagtaacttccctggccaatatctacctactgaagctgtactcatccttcaaggccaggcctcagcagctgtaactcctccaagaagccctccctgattcccccagttggggatgccttctgccttccctgcctcttttggtgaccaggacttgtggagaacgtaggagggaaggaggtgagaaggcagaatgaatggctggtgagtaagtggtaggcatgtgaccagtgtgccagttttcctggaggtgcaatttgcccttctatggttttgccaagagcaggggaactaacggcccacagtgactgccttctcaaggttgtgcagctcacctgaatgtagcaacagaaagggaacaggaggggcaggggcagagaagcctcccgtcccacgtaaataattacaaacagagcacatgacccctggcggtttctgaacgcgcctggcaacagctccaccacctgctgtttggaaagtcagattcacagaagctacaattacagactgtcagctgggtcttttcatggctggggaccggaggccaaaacttacagcccctaactcctagctcagtgctctttccacttcatctcccctgccacctgccagacaatttacacaaacagcccatgtgatgggtgccagtgcagagatctggggggccttctacgcttgtatatctctacctagggaaccatctgtctcgtgctgtttttctccaggctctgtcaagggtctcatgactccacagctgggagaagggagggtgggggcaaagagaaagaaaaagagggtggcagagaggaaggaagggggagggatgggagaaaggaaggagaaaaagcttcttgggggttggctgctcttttgaaagtgcactcacacttcctcccatttcctgtgggcggccagaggcctgaacacagctgctctgctgcctggggcctgacaaagggagtccagaccgcacccagctcatccactgccccatcttttagctctgcctaacccctcagccccattctgctgagtccttgaggccacctccaccaaaagctactgcgcatggctttatttatcacagattttcaagttcacaagcaaaacacagggaggagttgaaaaagtacttcacggctgggaacaagccagggctgtccctcatcaggaagaagtcttaaaaagtgatttcctattttcaattccatgaggtaatataagtaaaaagaaccccagcatgggctggcgccagcctcatgccgacctacctgctgggctggcctgggcctcctgtgaacagaactggggcaaaacatctaactccgtccacccttagttattctctagaggccatgaaatctgaattcccatttcccagaaaaccactgccaggccagcacaaacgccccctgcacttggtagttatgttcctcgctgttaattaaggagctggcaggcgggtgcacacagcactcccctgccactctgcccagtgcccagatagcacagaggaccactcgacagaaggaatgttctcagcccaggctggcaccaacgcaggtgctcctgaggcccagccaacaacaacttcacccagggctcgtgaactggggcaggaagcacctggccagtgacccccgtccaaaggactgagttcacatccaagctcctccaccccaagacccaccatcccaaatgccacctgcacagagggctggctcgaggccaggccccataaggtgagagggcagagggctgagggcagaaaagtcgtactgtgttgcccacgcctgcccccgtgactcagcgacgaatgggcatggctcagtatgtgtttgtgggatggctgagtgcagggagctttctgcttctgctctgtcattgcttctctatctgagcagctcccagaagaccaagaactggtctagattagaggcagtggtcagtggcctgtggccagatcctgcaacagatgagaaccatctgggccttactgggcttttaaaaacacatgaattagttgctgatgtttaaaagtcaggagacctcaattatataaaagcaaaggcaagtaaacaagtgacccaagaaagaaaaaaacgtagggggtgggaagcttgttttctttctttttaaatcaaaagatgtggccccccgggcctccattcctgcatagtaacaggtgccccttgagacaggttccacactcttcagtctgccgggggcctccaagcctgcttcactggcctgtcacctgctgggctatgcagcctttttgtgttcacacttcaccgtctagggttagctggtgagtcaaaaatgcttcgtgggctcttccagtcttgccccagtccccaaaaagcccatcctcctgctccccggaactcagcattgtggcctctgcttttcaaatatctaacagtaacttgaacttgagacaaaagttccttttccctactggacaggaactcgggacaggaactcgaatttctctggaggcaatcctggttatagaatggagatctaacagcagcgtgccacccgcacattgttcattattcacagaatctaaatgcatcaggaaccacattatactgcctgcagtaacaccctagcaaacattaacagcatgtgctgctccgacaccacagaagcaccgctttgatggtgctcccttctctttaccacacccacatttccatgtcttaatgcctgcaagccccagaagacaacaatcctgacgtcaacccaagagaagaaatgggctcagggagtgacgtgtggctaagaaagtcatacccacaagccagactgtggtcaggtttccagatcaggctgcaaggccctctgcttcctaaacacttcccttgaagggctcatttgggcaaaggcactcaatctctaggagccttgtggctaggtgcttcctgccccagttcaagcgcattctctgggtcaaggtcaatgacaatcacagcctgagccctgaccttgtttccatgaagcgcaggatgtcctcgggtctcaggcacttctcctgctggtaatatgcatgtggcaggaactgaaaccgcagctggtacacctggaatttgttctgtttttcttccatacagaaggactcctggacgtcaattttctgcaacacctggaaccagacggacagagagaacttgacttgttcaggtcctaggtgactgcgcaatgtgagtgggttacgagacccaagggtttacagagatagcagctgagaccacaggccaaaccccaaagaaaccctggtgagctatactggtgtggatctgctggggggcccacagcctgcagtcacctccagagagtggcctgaacctcctaggagtggcctcagcagagcgggtaggcaaactcaggaaatggtttatttttcaggcacaggaggatgctgtggaactaatgactctcttaaaagcttcctgatccatctctgctcagcacctggcagagacagcttatctctcattggtgggaatctgagcctagggtcagagcagtaagcaaagcctgttcttcacacatggggaggatataggaacatgccttcaccccgtctgcaacctgggaaggagagacgttacctcccccaagcacaccctggtgagttgcttcttcaggcttttcactctcttcagggctttcttggtgttgagcacgggcacgctcatcatgggtgtcttgatgttggcgctggccaccatgagaatctcccgcaacctgtcacagaataagggcacatccaatcatgagtggcaaccagaccttctgtttgggtgcagcttctcctaatgatgtcagagttcttttggaatctgagagaggcctggggatctcacagggataatatgctagatcagagaatcccagctctggcctcgtgtgcaacagtaagggactcccctgtcagtttcctccctggagggcccactccttgtgctcagggctttgtctgattcttgtttcctatcacctgtgccttgcaaacaacaggtgcctgctgacgcttactgaatgaacaagcgatgcagggaaggcaactagcacccacagtgctcctgctgagctcagccagccctcactgcctggatgtatagtgggtcccagcctctggccttccacagaaggaccccctgaggtttggaaagtgaggtacctgtccagagtctttctgctagaaaaaggcagggccagggactgaatgcagatgggtctgaccccacactcattccccttgtccagcacatatatttacctgaagggccagggcccagggccacgtgggggcacgttctatgtgaatggctcccctggagttgggcaaccaggcaccttgtgtggggcttgttaacaatgtacgttcctgagtccttcccccagcagtgtgcagtctcacaggcatccccaggaacgtggatgcaggagttggcagaggaataaatggagatcctaccaggcctgggcaccaaagaaaccagctgggctctggaaattctaaccctgatccccactttaatgagaccctgtccctctctcacacagacacactctctcattcacacacactcactcaccccctctcattaaatggccccttctccaggagaggctaggacagaccccaccctgtgctcccttgtgccccacaccttggaatgcccagggtgacgttcatctcgcctctgcctgcaaagtggaaggtgttgagggtcatctgggtggagggctctccgatgctctgggcagccagcaggcccacagcctcgcccggctcacacagtgagcgctgccacttcagctgcagcaaggtcctcaacctagagacggtggtggggggtcagggtgggggttgtggcaggggtcaggagcagacaccacagactgtcaatgctgcccgaaaccagaaaactgaaacctctacctctttctggactcgtttttcctaggcaaaagatccctctaatcttcaaattcccaccagtgaccctgagatgtcctcaaattacacagcacagatcccagctgggtggctgaagctctagacattcatgcttggactcctcatgtttgcccccagaatgtcacatatccactctgggactgttaccacaagccccctaagcaggagaatttctgggttcattattcactttttcctttatccattctttcttctcaattatgacaatttggagacagtttaaacctcctgctataaaaattagaaagaggttcactaggccattatggggatgggggtgatgagagtgtttatatttttagttagtgcaaatggctgcagaccacatcagaagtattcatgccgcacgattctgtaatttactaaccatttttcctatgaagcctgaccctgttaagaacagccactaggagcgctgagctacactgtgtgtgtgtgtgtgtgtgtgtgtgtgtgtgtgtgtgtgtgcgcgctgagctacagtgtctgtgtgtgtgtgtgtgtgtgctgagctacagtgtctgtgtgtgtgtgtgtgtgtgtgctgatctacagtgtctgtgtgtgtgtgtgtgtgtctgtcctagtccaagctgaggccttcaaatgggaacccaaagctcaaaggtgtgtgtgtgtgtgcgcgcgcgcgctgagctacagtgtctgtgtgtgtgtgtgtgtgtgtgtctgtcctagtccaagctgaggccttcaaatgggaacccaaagctcaaaggattactggagtaatcggatccaaggcctcatgagaagttaagacctggtgtccctgggcatgaatgacctgccctgggtcacacggttggcagcaggtgaacagtgaccagattccctgactctcagtcagccccacccaccacaccaaacccaagagagcagactttcctgcaagcctcccagcagaccactatccctatcttggcccagatgggggtgtccactcctgcctcccttgcacttgttcactcctgggcccttggggcttgtgcgttgcccctggctgtcttactgccctccctctagctgaagtctcaaacccaggaggcagccctcttccggagtgagtagggcaggggctaggaggcaggggctaggaggcagattctcctgcacatgttgtgcaacaaatcactgtcaatacctgtcgagagaaagctctgatttctcataactcttctctgtttgagctgcccactcttgactgtagtcatcaacctttgtttcaaatgtttctgacactgatgcaaagtagatgtcaggacgccagacagacagactggggtcaggacaagcggccgccttcttctggtatttccttcggctttcctcatccaactcataccacatcctcagcatctgaacagaaggatgggtctcagctatgtgggagggatacccagtagcataagagggatcaaaagcattggcttccaatgagaataaagggagacagaaagaaacctgattgcaatgagaaaccatctccccatttaaaatggggagagacttcaacctgtcctagggcaccctgcttgactataagcctagcagctcttcatcctggcccattcaagcccagggagggcaagcatgtaatttactgagcaaactgggcttcttttagagtgaaacaggagactgttatgattaggctaggacaagaggcaaagccacgactgtctcaggccagctaggatgcagtcactgtgctggatccatggttatttctggatccaggctctttcacacgctctgtgccctcaaggctgtcccaaagtgactgcttcaaagagatcccctgcttccagctcccaggtgtgcttggctgatgggaggcaccagcagcagagggaaaggcaggaggaaggggatcctggtatttatcctcaacccccctctagtgggtctctacccagggctctgtccagtggccctagcacatagtcgtcctctccgtttctcatgactgctccccattccttcacacctgggatcgcggggaaccccgaagtcacaggccccagttagtccccccaaaccctgcctacacccttgttaagagtccccaccttacattcccatttgagagccattctgttctgactgacggtgaacaaagctggagttcatgattctaccttctcttaggaaaacagcccctcatccctcacccactgactaagcctggacgtgctggacattaaggacaccacctccctgcatcacctcctgagtcccagggctgcggccattgcggttttcactctcaagtttcagggctttcacagcttcctgaattttctgggaataactcaagaaggcgcctcttctcagcagggtgttggggtgcttgctttgccattttttgatagctctgaagtggtggagagcttttttgggatctgctctggataaaacttcatggagatgctgtgatttcattatcacctaaacaaacaaacaaaaaaacaaacaaacaaatcacacacatgagatcaaagagatgagggcgtgacaagagggccatggagcacaaattcaggggacccaggtggctggtgtggagccctcatgatggggccgagcaccactctcagagaggctgagcatccattgttaatcagggccctcactttgtgcaaaccagatttgggaaccaatggtcttgggagcagagggagacacaggaaagaaagcagcacactcagagcccctccaggagcacaagggagtttctgggaagaaaggaagaggggaagagtgatggccaagctcagggataggaaccaggatggaaaggactcagcaccagagcacaaccctcaattctaccatcagcttgatgaccttagacaggtcacatcggtttcagtttccctatctgcaaatggggtgactgcccagtcaacagtgatggtcactacaagggcattaaggtatacaatgaaaatcatgagtttgtgtctgacgggcccatgttcaaatgctggctctgccactcaccgactgtttacttatgctttgatactcagttgcctcagctgcaaaatcggcagagtaatgcctacttccctgggttgcagtgaggaggaaaacggatagtattgatagtgtgctttagctgagggcccagcacacggcaaatggccccaaagagtaggtattattccagaggtgctcgtgccctccagccacctcaagtgatgaaagttcacaggctttgaaattgtcaagtgtttcagggcactgaccggtgtcttataaacccttcccactctactttccaatggccacttggactgggttgcaaagctcagcgcattccagttctctaacctcggtgggggaggcctactgctcggcccccaggctccgggatctagcacactacctcgtagttgctggccaggaaggggaactgcttgggctgcaggaactgtgtcttggggatgtccaggccatcctccccatacaggaactgcaccacactgccgtcactgtcacggaccgtgagatcatactgcacgaccagcccctctaggtgcttgatgatgcacctgtaaggacaccatcggctcagtccccgccggcccatcacctccccagggcagcctctgatgagggttgggggcagtggaggggagggaaaggggggctcctgttctgcaggcaaacaagacttcagaacaggctagatccaatgccccggggtctgggcttgctccagtgtcccccagccaggggctgcatttcctgatggttttctaggaggaggaggctgcagccatgttactgagcagcttggctgccacccctagacctgggctcccatctagccccagctgctgagatgactgtctgcccctacactctcccacaatgcagagctccccagagaccagtgtccttagaaccaaaagacgggcgaagcaggggagctgtcaaggattctcaaacttggtcagcccagggattgccaaggacactaaggggtattgggaaccacatgctgatgtgaatccctccactggcggcctttctcctcagttttatctcaacttcttctgctctctgccctggtcctagcccctttgcttacctctccggacactctgcctaggtttcccctcctgccaccctaacagtgggcttcccagcagtcactgtccctccaccccaagctgtggggacagagctcaatgttagtcactactgtcttggcagctgagccttctaggaagcaagataagcttgccactgcccaagaccttctcccacagccatagcttcccccagggaatggcagaccctcagaacacagagcccttggtataagcctctgagctcatgctctaccgatcctgcgaaggggaacagtgtttgctgctttctgtctcaggccattcatggaaactttccaaaagttttttcatccaaggaatcttaaatgagctgctgatataatgtgaaagatgatggcaggaagggccctggcactctacctcaaggggcacggcagatacattttacctttggagatagcctgagcggctggttttcacagcagtgtccaccaggccctctcgtcctgccatgcagtggaagaagaactcctgcagagaatgggacccaggtcccaaaggtgacagtgaggacagtgcgcttcctgaagggctcaggccaacacctccagcagcctttcctgaccagacaggccactcccttccctgatctcctaggactttttgacctcgacagctacaatagcccccagtgtcttctgccctaccctgtagggcagtcatagttcacctacaattaagcctagaaatgagggaaaaagctaaatggaaaaaccaaaatacatacaggaggtttgatgccggtgaggaacctgccagtgacaaagccaccagccctgggggtgaactcataaggctcaaagcagggcagtgacttgccagacgccatcagcgggggtctccgaccttccagttcaatctggcccagcaggcacgagatctggaggacaggaaatccacaggaaactgaagatccacatgtgtgtttaacagtgctttgtcccagcagggaaagtataatctgaccttgaagaaaagctgcatggaaaccgagttcttgaaggctaacctacatttctaaacaaaccaggaagccttcattttaagaaaaaaaaaataccttcctttggttgactgatctggattttcacatttggggtcagttgaaaatgggtgctctctataaaaagagccatgtctcagaaccatctcatgttatacctgtaaaggactggagggtcctgatggggaaagagaggcctgcaggaaacagccatttattgcgatcctcacattctagagccaaaagggaactcagggccgggtgtggtggctcacatctacaatcttagcactttgcggggctgaggcaggaggatcccttgagcccagaagtttgagaccaccctgggcaatacagggagactctgtcttattttcaattaaaaacaaaacaaaacaaaacacaacaacaacaacaacaaaatgggaactcaagctattgagctatttgcttagaaagctgcctgttaatactcttggcgtgttggaggagagcagtatatctaggtttcgatgtagtcaggggatttcctaacggctttcggcctttctgttgtcacactcaacagacaatggggtgggcctttagaccctctcaaggtcaccaaggtttaaggttaagaaatctctaggacaatgtttatgtttataatttaatattatgaaaagatcggccaggtgcggtggctcatgcctgtaatcccagcactttgggaggtcgaggtgggcagatcacgaggtcaagagattgaaagcatcctggccaacatggtgaaaccccgtctctactaaaaatacaaaaattagccaggcatggtggcgcatgcctgtaatcccgagaggcaggagaatctctggaacctgggaggcagaggttgcagtgagccaagattgcgccactgcactccagcccggtgacagagcaagacttcatctcgaaaaaaaacgaaagaaagaaagaaacaatcatgcaaaattacgtaaaaattgtgtgagtatacataatttatctatataacgtgaatatatgtaatagtacagtttgtaaatttgtaatatatatctacgttatacatatcccatctgcatattcataactacatctgcctttaacattggcatgttaacagtggttagctcctgtagtgatttctacacgctttcctctttttacttgtcatgttttatagggaacaaactgaaaccacctcctgctatcccccacctgcctttgctgacacctgtaaagctgccaacccgcctctgcacatacctgcatcgtgttcacagttgaacctttggctcccgactgcaccatcatctgcaggctgttctctgggaactgtctgtgtaggccaaaaggcatgcatgcctgcagattaaatcagcacagtggtcagtgacttcaccttctttaaaaatcccagaatcaggatgtaaatccaggaagcagaagcaatacagccagaatatttattcagacctaagtaccaaatcccactcgaggtaagagaaagcctcattcagcattaatccttccctggaacccctgagaggtcaaacaggtgctccctgccctgcactcgctggacttcctctgccaggatccccgaggtttcattcattggccaaagagcagcaaaaagggagaaggaaaaggagaagtagaggggctggcagatccagttcgtgattctaaaaagaagctggagaagaataaaatttaaggtgatgcccttgattcgcccagcagagcctggcctgggtcctctcccagcgtgaataccaacatccgcatcatgtcacatttacgaacatgccacccaagccccatgtaggaagctctgtcttggctcaagagccagcagaaccaagcatgccccttcagggggatcctggggagatgctgagaagggggctctgagtctggggcttctagcctgtgcctggaattccacagacttggcccaacacaggagaggcagagcctgggtgggcggaggtggtgggaagagggcaactggagggacaagaaaccattctgagatgcatctgaagacaacttccctactcctagcatccccagtcagccctagaagctgagcttcctggttctcagggaggtgctaggaaagctcctgtcaacaaaacccctcaaggatggaacctgtccccatgagaagtcggtcttctcagcagcctaagggatgctaaaagccaggcaagagagcactacagacgaactttgacttttgatgagtgttggcattgcctcctcctccccactcctcaggctgggccccagggcccaggaggcagggtgagggccaggccagctcctccaagcagcaggatggagaaccctggctctggggcagaaaggcagagaaaagcaggctgtggtttcagctcatgcagagatttcccctctcctttctcaactgcccaggaactggcttggcattgtgtactagtagctcctgaagcctctctgcagccctgtgaggtggtgcccctcacagccccacttccaggtgaggaaaccaaggcagggactggttatctcacttgcccaaggtcacacagcaagttcaaggcagagccaggactggaacctgagccttcactcctggctccgctgcatgagcagccagggcgatccgggtccctcaccctgcttattcacccctggtggccccattcagcccctttaatgcagtcaccccaaaataaaaacatttataaagaaaaacagcacaaagcattctctcttggcactattctgaggcctgtatagaccctaactggggcagggaacaaagccctgggcccttcaaaacaacgagttctacccatcccacctcgcatctcacctagtcagctgttcaacagccaaggtgctctgtagggcccaggtgagaatcaaaatgtaatttttttaaaaatcagcattcatagtggtggggataaatgcatgcaatgctgggctaaccttgttaatctcattgctgtaatggttcacttcctccttgaacttcagatcaatcatgttaaaatccctctggtccttgcccagatgggcatcctgccattttcctcggacctcatcatatgatgcggcttctggcaggtttaatgcagccctgacagcctagaatgagaacagaaacacagcggaggctgaggccaaacgacgagagtgtgggttttgactcagcacacacttcacccctctagggcaggccacggcctcgaagtccctccttacctggggcccgcagtgggtggattcttcaatgatacgttgcctcttgacatctgcctttggcttcaccaaaatgtcttccacgcctgtgaagtgaaacagacaagcttgtaggcgacctcaggcctgatttctcccaccagactaaactcagtaaggccagagcacagagtccagtgccacagatgcaggaaatacctgagtaaggaagatgatattaacatcattattaacagattgccaccatctcttaggtgcttaccagagcccaaaccttataatccccattttacaaatgacaaaactcaggctcaaaattgggctactttcccatggtcgtatgggtagaaagtaaacccaggcctgggtcccaaattcatgttcttagccaccagctatactatctccactccatagacatgtgttggatgaataggctgaaggtgaagaagaggttttggatgaaaagataagctcagggaaaaagagagagagaacatctcagtctggggtcccagaagtcacatgtcacaggggccaccctatatagctgagtatacctgtgtaggcacacacacagacacacccgagcctgggtgacaaggaccaccaccacaggtccctcagcattgcttcaggaggatgacagcctgggtcacttcagtgaagcctgcccttctggctcaaagggttgaggaattcctcatcctgggcagcagtaggtctttccacatcaactcttgatcaaactagtgtttttttttttgtttttgttttttgagactgagtcttgctctgttgcccaggctggagtgcagtggtgtgatctcggctcactgcaaccgctgcctcccaggttcaagtgattctcctgcctcagcctctccagtagctgggactacaggtgcacgccaccacacccagctaatttttgtatttttagtacagacagggtttcaccacgttggccaggatggtctcgatctcttgacctcatgatccacctgcctcggcctcccaaagtgctgggattgcaggagtgagccactgcacctggccaaaactagttcttttctgcaactgtaagtgctactggactcaagagtccctcagccaagatctgagtgggaaagaaaacagcaggtgtactgttcaaaagatggggctgaaatatttggaattcccaacgcaaggtcctggagggcttctaagaacatgtgtgaacagaaggggaaagaaacagttcctctgtaagcaggccacaccgtgaaagtgggcattcccatgggttcagctacaggccaactagctgtgccctttatggaccccgctagctgagacgggctggagtgaagtcaatctctcgcctgttcccccttgtagccccactcccagcttggccctgcttccttctgcagccctgagcctctggatcatcttcacactcaagggaccaactgctctttgtaccatgcactaagcagagctaaagcctggcacctttgttaagtttgttcctcatcatgagctgggtgtgggatcttcctctattttcgtttcaaaagcgctctgattttttctagttagcagaaatccttgtgcttattctaggtcaccatttgaaactgaaatatacatttcatgaggtgtagtcatcatgcttcactttctttggttatcctggaaggtactctagtctggttcccaactggaagtgggtgaccttggaccttgagcccagaagtggctcaggtctcttagtggaattaagatgggggaaggtgagtttcagctgccaaacagacttaacttataatccttatcctggtaaaataatgggacatataagccaagatgtttgttcaaggatgctcatcccagcaataatgtgaaaatctggacgcagcctaaatgtttaattataggaactggttaaataaactacaatatatccataagaatggaataatctgtaattaccagacatgaggatgtagacttgtattagctgatcccaaaggacatttataaatacatttggacatttggtgggtgggtgggtaagggaagtagagtatgtagcgtaggatcccactttttccaaatgtatttgtactagaaaagtctagaaaaacaaacatcaaattactattagtggttatctctgacaaatgcatgctgggtgattttaaattatcttcatgtatgcttttttttttttaacctttccatgattaaatatatgatacaattaaaatagaataaaatgtataatgcaggccccagtgtgggccaatgaacaaactccagctgcagcagctgcaggtccacaggccctacgctgagactcccactctgtctgcacacgagtgggtctgtgaagcaaaggagccttacttccaccatgaaccagacaacgcctatgcacactgcggtgcatgcctgacacgcagcatctcgcgtccccctaacgcgaacagcgtggaagggctggaccctgctctgtgtacatggaggtgcagtgtcctccataagcctggccaggggctgagcctttggacagatctgatctcaagcccacactaaaaggggccaggtgactgcttcaggggagccccagggcagtgagcccagcactcacccaaggtgaagcctctttatcaaagccattttcctaaaacagcgtgcactcatttctggggtgcaaacaaggtagttcctcttcgtgtcttaggatcaccccgacaggtttgcccagcatagtgtttccaagagcgctgatggccccaccgcagtgggaaggcgtgggcagttctttggctccatcacccaggctggagtgcaatggcacaatctcggctcactgcaacctctgcctcctgggttcaagcaattctcccgcctcagcctcctgagtagctgggattacaggtgcttgccacgacacctggctaatttttgtatttttagtagagacggggtttctccatgttggccaggctggtctcgaactcctgggctcaagtgatccacccaccttggcctcccaaagtgctgggattacaggtgtgatccactgcacccagccggcagtgggcagttctgacaaaagggaaacccctctgtggagtgggatgggccctgagaattctgaaagggcacttgtgtagcagggaatggggttgtaagagtatgagaaatcagtccgaggacagaaacctgtaaagggaggggttaggaaagaaacagaatggaaatgggcacgagggtgccattctgcactgtgaacgggaataagcactggctgtggaggagaggggtggccaagtgagggcgcctttgtaggaggagcctggttacttcccagctccttcccgagaggacacagaaaagaatttctagctgtgtaatgtagcacacatgaagcatatggtctacaaaggaaaagaaacctggcagttttgggggtgaatggactatctgttaagaccctgtaataaagcgtggtgcactggggacctggaaagacttctccactgggaacacacagaagccttggaaatcttcagtgtggacggctctctctgtcctgggcctgggagatggccaggcggctgcgctgacgggtcactgccccagggcagcgagcccggcacttacccaaggtgaagcctctgtagagctgcaggtaggcggtgaagaggcgggccaggcaggttagaaccttgccgctggtctcgcctccatagatctcatagcagcagtggaccaggccgtaggcggagctcccatagtgcgccttgtccagcactccgcagagcagctccccttccctgatgatcacctgcagagggcaaggccaccaatgccgggctgcgggtgatgcctcctgtgggagtcacccaccctctactccatgtgtgaccctcgttgtgcaagtccctctactgtgacccgcctagaatccttcatggaaaaaagtagggcatatgtgaaactagtattttctctctatatatattattattattttttaatataacagaggcaagcatatacagaccagcagttttttttcttcccttcagggactataccacagagacatacacacacactcacactctctctccatgtgttttatatcccctactccccacacccacccacgctgacttgaggtcaagtatccttgacaaagacctgtgaccggacatgggagcttctagttacaaggtcttcctgaagtggcgagcttcaacctcgtaactgtgcctctggcctaggtacttcctcccttgaaccctgggagtaacaacaaaatcttcctaacatcctctaaggcctgaatgtgtactttctcaaagctgggttaaagcattagaagctaatgaacagaaaagcatttctagctgcgtaatgtagcacccatgaagcatatggtctataaaggaaaagaaacctggcagtttcggggtgaatggactgtccattaagactctgtgataacgcgttgtgcactgggggcctggaaagacttctccactgggaacatgcagaggccttggaaatcttcagtgtggacagctctctctgccctgggcctgtccttttgtggcctggttcctaaggctcagagttatgggtgtggagccttataccagtttgattatctgaagccactcagcagtcttgcaggaaaacaggactctgcattgccaagctttgcataatcaatttcagcctttttgcaggagaagctttcctaaactgcttgtgagttttatactgagggtcaaatgctggagatcaaccctgaacccttccgaaacaaaagctgacaacaactcaggcacaacgccttctcttctgaggcacagtacctgcttctgtgaatgtgcctccatttctgtctccattttaaaccaatctgtctaaccccggcactagaagtctccactccacacagctggacagccatacctgggactcgcacatcgagtcagggttaaagccaggaacggatcgaggagtttccttcacccaggctttcccagtgattttcgcctttccagataagttcagtgggatgtggtcctctgggattatatttatgagcagcgttgacacaacctgcaaagaaaaagaggacaaactgatggcaaaaagaaaagtgatggcaaaatgaggacaaactgatggcaaaaagaagagttaagaacttcccttttaggacctcctgcccttgcaatgccatttctgatgatctcaggtatggcaagaaaaacagacaggtccacctccataggacaaggtgatttcaggttttatttaaaccaatgaggaatgaaaacaaaaaagaacttcactgggatttttactccctaaaatagttcttaaagtgaataatcccctagacttgaattaaattcctaaatagaccaaaggaaggagaggaaaaagtaaattgttttcattttatgccacatactcagatatttctttactatgactggaattaattatagctactgaaaagccaaggaatctttccctggccccagttggatccctcagaggggtcatccacccaacaagcactgctaacaggaagccaagagaagcgctttctcaagcggctgctctgcagagagctcaaagggagacagctttatctggagataaccagagttggctacagaagggccgaatgcaggtgcacacattcccagagatgaagcagggcaggggcagaccggcaggtgtgacaggctccagggctgggagactaactgccatcaacagcgcttagtgtgcctgcagcaggccccacaaagtagtgtctttagatgtgtgcaacgagggcgcggtggctcacgcctgtaatcccatcactttgggaggctgagacgggtggatcatgaggtcaagagatcgagaccatcctggccaacatggtgaaaccccatctctactaaaaatacaaaatttagccgggcatggtggcgtgcacctatacttccagctactcaggaggctgaggcacgataaccgcttgaatccagaaggcagagattgcagttagccaagatcacatcactgcactccagcctgggtgagagagtggaactctgtctcaagaaaaaaaagagagtgggcaatgggacagggcagttataagagcagctgccttttcacccacgtgcaccaggagcaggggacaatggacaacagcattattaaagagagcagaaaatattctgttttctcagcagaagatgaccagaaaggttatgacccacactctccatgcctcaactccatagaaggccagcactgtgcggtgagtggggtgagggagcaaaggcaggagagtgacacgtcctggggtgcctacttcaagctgcacctcaaccaaggtgccacatgcacagtggggacccccaggctaggcatagtcaagactggaacttggtgtgaaaggtaacagaaacacacccatccaagggcagggaaatatgacctgccacttcatctgtaaaatcaatggggcagaagagcatttgataaactccaacaccctttcaggataaaaatactcaacagactaggaacagactgtcaccaacctaataaagggaggcacctatgaaaaacctactactaacatgctcaatgatagaagactggatgccttctgcctaaagtcaggaccaagacaaggatgtctacgcttgccatttctattcaacaatgtactagaggttctagccagggcagttaggcaagaaaataaataaaagacatccagattagagagaaagaagtacaaccacatttgcagatgacatgatattatagagagaaaacccttaagtgccaacaaaacaaattattagagcttgtaaatgacttattcaaagctgaaggatacaaggtcaacatataaaaattaattctctttctctatattagcaatgaacaatctgaaaatgaaattaagaaaaagttccggccaggtgtggtggctcacacctgtaatcccagcactttgagaggccaaggcaggcggatcacttaaggtcgggagtttgagaccaacctggccaacatggtgaaatcccgtctctactaaaaatacaaaaattagctgggcatggtggcgggtgcctgttatcccagctactcgggaggctgaggcaggagaattgctttaaccagggaattggaggttgcagtgagccgagattgcgccactacactccagcctgggtgacagagcgatactccatctcaaaaagaaaaaaaaaaaaagaaggtagtgctaagcgagaagatctagctaagatcactgatgaaggttgccgcactaaacaatagatttgcaatgtagataaaagagccttctattggaagaagatgccacatataggactttcacagctagcgagaagtctggcttcacagcttcaaaggacagtctggctctcctgttaggggctaatgcagctggtgactttaagttgaaaccagtgaacatttaccattgtgaaaaatcctagggcccttaagaattatgctaaatcgactctgcctgtgcctataagtggaacaaagcgtgggtgactgcacatctgtttacagcatgttttgctgactatttcaagtacctgttgagacctactgctctgaaaaaaaggttccttcaaaatattactactgttcattgacaatgcatctggtcacccaagagctctgaagatatgcaaggaaattaatgctgttttcatgtctgctaacacaatatccattctgcagcccacggataaaggagttattttgactttcaagccttattatttaagaaatacatttcattaaggctgtagctgccatagatagtgattcttctgatgcatatgggcaaagtaaatggaaaaccttctggaaatgattcaccattctagatgtcattaaaaaatttgtgattcatgggaggaacatcagtattaacaggagtttggaacaagttgattccaacccttaagtatgactttcagagggtcaagacttcagtggaggaagtaatggcagcagtagtagaaatagaactagaattagaagaatctataaaggaaaaaaaagaacaaaaaataagtgttggtgaaaatgtggagtaactgagaccttcatacattgttagtggaaatgtaaataacacacctgatttgaaaaatagtttgcaagttcctcagaaaagttgaatatagaattactatatgatgcagcaattctacttctaggtatatacccaggaaaactgaaaacacacgttcatacaaaaactggtacacaaatgttcattgcaggtttatttgtagtatccaaaaaatggaaacaatccaaattatccatttatcaactgacaaatggatacagaggaaacaatggaatgttattcatccataaagaggaataaagtactattacatactaaaaaatggatggaactggaaaacattaagtaaaagaaataagtcataaaaggctacatattgtttgatacaacttatatgaaatgtccaaaacaggctaattcatacaggtaaaaagtagttgtcaggggatgagaaggaaggaggaattgggactgactgctgtacctattaggtacatgtcatctttttggagtgatggaaatgttctggcattacagtgtggtgatggttgcacaacatagtgaatacactaaaaacctacttatacactttgaaatggtcctttaaaaaaaaaagagagacagggtcttgctctgtcacctaggctagagtgctgtggcacaatcatagctcactgcagcctcatactcagcctcccaagtagctagggctataggtgtgtgccaccatgcccagctactctactctactctctctactctactctactctattcatttattgagatggagtctcgctctgtcgcccaggctggagtgcaatggcacgatcttggctcactgcaagctccacctcctgggttcaagtgattcttttgcctcaacctcctgagtagctgggattacaggcatgtgccaccatgcctggataatttttgtatttttagtagagacagggtttcaccaggttggtcaggctggtctcaaactcctgatgtcgtgatccggccgccttggcctcccaaagtgctgggattacaggtgtgagccacctcacccagccttttttttttttttttttttttaaatagagatgggggtctcactgtgttgccaggctggtcttgaattcctagcctcaagcaatcctcctacctcataaaatggtaaattttatgttgaatatgaattatatcttaatgaaaaaaaaaaaaacataaaggacccagacaagaggaactgaagtctcctcttgcactaacattctagaaatgtataatttactttctggtcataaactatgctagggagaaaaaatctgcaatgttttcttaaaccaagaagggcagcaatatctatgggaattattatttatactaagcctgtattaaccttaaaaaaagtcttaaaaataaaatggatttaaaaaaatgtattgaaatgtctatatcctttgacccagcaattgtactttaagaatttatctaacagatatacttggccaggcatggtggatcatgcctgtaatctcagcactttgggaggctgaagctggaggatcacttgaggccaggggttcgagaccagccagtgcaacacagtgaaacaccagctctacaataataataataataataataaaagataagtcaatgaaagtacactaacatatacagaaatgggtgttcaccacagcactgtttagaatagtaaaaaccaggtaataatcggaacatccactaatagagggacagttaagtcatctgtggtatacccatatcactgaatacaacacaggaggggttaaaaagaacgaggcagatctacatgtacagacacagaatgagcccccagtacatccagtgaatgaaatcagtcacaagacaattacaaaaacatttgtcagcatagcctatgaaaacatttaaatgaacttcttgccatatttagagtgtgttagtgtggtcccaatgaaaaagcagactgtctgatataatggagttccctttggaggacttggtggctcgttcagagtaagccatcttaaagaccagccaaatctgaggtccatgtgcctggccatcaggaaaatgcatgcttcaggtaccaggatgtcatggtcaaacaggtggttgtaaatatcagatttatcaggtggttgaatgtcagatttaattgtggttcatggttctcctgaacagtcccagggaaggtatgatatgattttattatttcttttattttttttgaaacagagtctcgttctgtcgcccaggctggagtgcagtggtgcaatctcagctcaatgcaacctctgcctcccacgttcaagtgattttcgtgcctcagccttctgagtagctgggattacaaatgtacactaccacccctggctaatttttatatttttagtagagacggggttttgccatattggccaggctggtgtcaaacttctagcctcatgtgatccacccaccttggcctcccaaagtgctgggataataggcataatccaccatgcctggcctcattcttatttattttctatgagagtatgtgtgtatatggagagtggggttggggagggagggagtttttccttttatctttatcaataaacttgtttacttttatagtttaaaagaacttgaaggacagagatctaataactgaattcataaagcttgtcgaatataaggacaatatacaaaattaattgtatttctagacaccaatcataaacaattagaaaatttaatagacagtatcatctaccatagcagtatccaggagtgaatctaatgaaaagatgtataaggcttttacataattgaaggacatactatgttcataatttagatgactcaatagtgtaaatacgttgattctccctaaagtgacctacagaggcaatgcaatcccaatgaaaaattctagcaggtatttgtgtgcacagtgtgaaagtttacaagctgactttaaaatttatatggaaatacaaacaccccaaaatagttgacagtcttttttttttaaaggtatattgagatgtaattaaagcctatcaaggcagtcttgaagaacaaagctgtagacttttactatcagaagtcaagatttagtataaacccacagtaattaagacagtgtgctgttggtgcaatggaaacaaacagggtccagaaacatacccactcatatattactacttggtttgtgacacaggagtactagcagtagagcagtggacttttcaacaaatgatgttgcattcactggctaggaaatccatatgggaaaatatgactcttgacccctacctcacttcatgcacatccacaaaaatcatccctaggcagatagcagacccaagtgtgaaaggtaaaacaatatagctactagacgataacagaggggaatacctacaagacctcagggcaggcaaagagctcctacaggactagtcacaaaaagccaagattggctataaattagaaacttctgatcattagaaaacagtattaggtgaaaaggctagccaccaagtagaaggtatttgcaatgtatatatctgctaatggacttataccaaattatagtttaaaaacctctcatctgtcaataagaaaatgacatagaaataggcaaaagatttgaaaaggcacatcacaaaagatgatatccaaatggccaataagcatatgaagaggtgctcaacctctcttgtcattaaggacatgataattaaaacagtaagataccactacatactcacctgaacagctaaaattaaacaaataaaccagaaaaagaaaacaacaacaacagctgggcgaggtggctcatgcttgtaatcccagcactttgggaggctgaggtgggtagatcacctaaggtcaggagtttgagaccagcctgtctaacatggaaaaacgctgtctctactaaaaatacaaaaatttgctaggtgtggtggagcacatctgtaatcccagctactcgagaggctgaggcaagagaatgacttgaacctgggaggcagaggttgcagtgagccaagatggcacaactgcactccatcctggtagaagtgtgtattattacaagcattttggaaaactttaggaaactatctattaaagttaaacacatatcttatgacctagtaattccatgcctcaatagttacccactgaaatgtatatatgtgttcaacaaaagatacacacgacaagtgttcacagtagccccatttgtaacagtcaaatgaaggtaagtgaagacaactcaaatgtgtatcaatagaaaaatggataaatacatgatggcatattcacataatagaacattataaagcaataaaaaataaactgctactatatacaataacatgggtaacacacaaagatagatttcatttaaataaacttcaaggaaagacaaaacttgtttatagtgttggaagtcaagttagtaattacctttgacgaggggtagaaactgggaggggccgtggaggggtcttctgggggtgctggtgatatgctactttctgatctgggtgagagtttgcaaagatgtattcactttgtgaatgtgcactgagttataaactcgagatttgcaatgacaggcaaatctctttctttgcatgctctttgaacaaataatgagagaccttcggtttgtaaatagaaaatcaatcaagaggctgtatgaaatgacctggagaaacactctaagacttcatttcccagggcagtagaaataaacttcctaagctaagttccttatcttctgattctaaacatggtttttctctgtagcaccaggctgaaccatgaacaaattcttgtgtagtgtagtcactcttgcccttttcacctatttgcaaaataaaaaagcctgtaccaacctttagagatacaatgaaaaacttcacccatgacagaagcaaaacctgggcctatttcccaattttatttggtacaaaggatttgaaaaggatccaaggtgcagtctctaggcacaatgaaattaaaccggaaatcaacaatcgagatatttggaaaagccctcaatatttgtacttctaaataactgaacaacatacttctaaataactcatggattgaaaaaaaaaatcaaaagggaaattagaaagtattctgaagtagatgaaatgaaaacacaacatattaatttgtgggatgctacttaagcagaacttaagggggaaatttatacataaaatgcctacattgaaagaagaaaaggggtctcaaattgacttaaagaacttaaagaactaggaaaaaaaaaagagcaaattaaaccaaagtaaacagaagaaagggagtgataaagttcaaatcaacgaaacagaaaacagaaaaataaagtcaataaaaccaaagacttttttttgagaataaaactgataaacctctaggcaaactgatcaggaaaaaagagaagacacaaattatcaatgtcaggaatgagagaagtgacaccactacaggcaatacagatagaaaaggtcaacaaaggagcattatgaacaactttgtgcctataaattcagtaacttagatgaaatggacaaattccctgaaaaacacaaacaattaaagctcattcaagaagtagataaccaaaaatagctctatgtctactaaagaaatagaaattttaattgaaaatcttcccacaggttgggcgcggtggctcaggcctgtagtcccagcactttgggaggccaaggttggtggatcacctgaggttgggagttcgagcccagcctgaccaacatggagaaaccccatctctactaaaaatacaaaattagccgggcatggtggcgcatgcttgtaatcccagctacttgggaggctgaggcaggagaattgcttgaatctgggaggtggaggttgcggtgagccaggatcacaccattgcattccagcctgggcagcaagagcaaaactccatctcaaaaaaaaaaaaaaaaaaaaaaaaaaagaaagaaaaccttgccacaaagaaactctaggcccagatgccttcactggtgaattctacaacacatttaaggaataaataatatgaatactgtactacacaaactcttacagaaaaccagaggaaatacctcctaacacctcattctgtgaggccaggattaccctgataccaaaaccaaacaaacatattataagaaaataaaactacagaccaatatctatcacaaacacagaagtaaaaaaattctagacaaaatattagcaaattgaattcaataatatataaaaaggataatacctcacgaccaaggaaggtttatccaggaatgcaaggttggcttaaaaaggaaaatcaagttccaggtccacagactaagaactggagagcaggaagagaccttagagatcatgaacttgaagctgaagtcattgatttgggaccctttttcttcttttcaacctaggcattttatgtataaatttcccccttaagttctgcttcagtggcatcccacaaattttgttgtgttttcatttcatctacttcagaatgctttctaatttccctttagattcttttgacccatgagctatttaagaagtacgttatttagaagtacaaatattgagggcttttccaaatatcttggttgctgatttccaaattccattatgcccagaggccacatcttgaatccttttaaaatcctctgtaccaaataaaattaggaaataggtccaggttttgcttctgtcacgggtgagattttttagtgtgtctctaaaggttggtacgggctttttttttgccaacaggtgaaaagggcaagagtgactacactatgcaagaatttgtttgtgggttagtctggtttcaaagagaaaaaccatgtttagaatcagaacttagcttagcaagttaatttctactgtcccaggaaatgatgaggaactgagacacacagggctaagatcacatagccaattagaagttgatccttaaggctgaacttggatactcaggcaacagcagaagaacatattttactgtttttcattatttggtcgccacatatcatgtaatttggttactttgagaggaagtatggtatgatgcttctggggttgaaaagtcctgggtttgatctgtctcctgtagtcttgggcatgtaatttatcatctcctaaatggagataataatggtgtctgcattgcagattagtcgtgagtattaaatcagataatgtgtctaaagcactcagcaaacatatggaacttcccaacaaatattactattactccaccagcaccactgcctattaccaccatatttgtattatgaggacaccaaatttaagttagaagcaaaggacagaaactatgcagtctactttttttttttttgtggagacggagtctcactctgttgcccaggcaggagtgcagtggctgatcctgactcactacaacctccacctcctgggttcaagcgattctcttgcctcaggctgaggcgattctcttgcctcagcctcccggtagctgagattacaggcactaatcccacgcccagctaattttgtacttttagtagagatagggtttcaccatgttagccaggctggtctcaaactccagacctcaggtgatctgcccgcctcagtctcctaaagtgttgggattacaggtgtgagccactgcaccaggctactatgcagtctactcttgctagacactcccttgaagccacccagactcaggaaccccaaacaaaggggaaagaaagtcagactattgctggcttagccatttctctgtctctggtctggactcttctgagaataaaaccttttacatgagtggcctatttccttttgttacatacactggctgttctctcccaattacctgttttcctgtccacagcggaaagggcttcaggatggaaggagaaaggagcttcacgcgccccactttgtccgtgagtcctcggtacaccagctccatatagtgctcccgggtgaaaaagcaaccccgagtagtcatgcttgcccctgaaaccatgtgatcctggatcagtcccgccaatggttggccatcctataagccaaaacagacaacacaagaagaatgaaaataaatcttaagtcaaactctaatccctaatcgcctgcctggaagccactttctatcaagagcccttcttatatccctgtcttgtcttgcccacatcctcactatgttcttgcttgggagccaactgcttcccaaagcacatgaccagggtttagcactggcttctacgtttgccatttgcccactatcctatatcaagactgcttcaaactcatcccgttcccccggccttctctgtttaatcccatctggttctagttactccagcatatttttggcatttatgcctaaatttggtctggctgctgtcagctgtgttcttgtttttatactttggttttatgctttagtatttttcacacgtttctggcctggctcttctgtaaatcagtcatgcactcaacaaatatttatcaggagcctcctgaatgcctaggcactgggtaggcttttccctactccaggggaccaaacagacatggtcctttatgatgaagaagaactagacagtaaacaaatgattggataaatacaatatcacaaagtgttttaaatgccaaagaggaaaataacagggtgggtcataatatagacttgaggtgagggggatggtcagaaatagcctctccgaagggcagtttcacagttgaggcctgaggggtgagctggccagtgttgggaggaaggggttccggcacaggttcctcaagagagctgtgagtgggcctgatgtgcatgactgcagaagggagaatagccattattagttatctcttcacaacacagcacagggttcatggtgggcccttaataaaggctgttatctaccagatgccaaaaagaaaggcttttatgaaaagcctgagatttggtgagtgcattaatttcatttgacactttcacagccattctgatccccagtctcctgaaccttatctgtcgggtctgtgttcacggcaacataacgcacgctgaagtaaaaatagctatgctcactgacgttctttaagatgtagattttgtaaacttttcaatgtttataggaatttgagaaaaacctgtgccttggatataaagattattaatcatttgattatttgttaaatactagccaacagtatggtcatgttttataactaaggctaagggaactcacaaatgcagtctgggagaagcaccagaaatttaaccatatgtactaactcaaaggctaaaaaaggatccttgtcaaatggtctaaacactacagtgatgggctctatgtaaactcaaagataacgattacagatgggctggaaaggtggcacagacctaaggcaagatcagatggagcacacagcccctcttatgaaggctttcacttaataatgtacataaaaaaattatactctacctcttgttgcctagatggtcttattttgcttgggggaaaaacccaaaccagtattatgcatttgactcatctcacagtctttggggggcagatactgatttttccttttgtttttttccttaaagaacataattacaggttctgtgatctattcagtgccttttcctctctctgtccagatttttccatgactagacaattactttgatggctaaatcattttcaatgcaatcatcacaaattctatggcagaatgctgattaaagcaattactaaaggtctacttataattctaaatttcctaactcctgcttaggatcagaaagaacacctctgaatcaaaaccccagacaattgtcagctttactattctccttaatagcaaaatgacattacaattaatgtctctggttaggatgctttgtgaatagggtatccctgtaacttgaattttctagctgactaagtagaagtcaggaaacatatctgaagccttgcttaaaaactttccacaaagtatgggccctcaataaataaacagaaggaaaaaaaattagtccaaaaagtaacacataaatgaaaagtttaactgttttcatggaaaagaaatgagttccattcaactcctattttaagtaaaaagacgccacaaaactctactaagtacataaaaccaacgacaaaatgtactttaattcagtattatggttacttaaggaagataacctggtaatagagaagaaattgaattataaataaagaaatatggaaactaagggaaataaagatatgctaagaaaaattacctcaaaatactggttttcctagtttaaccaaatcagctcttgtccttttaggactctgccaataaagacatgttgcatttttataaccattagcaaatataaggattccacttcttggcatttacaccaaggactaaataaaatttatcaagaatcaaaagctctttacctccgacaaaagaaagtgaatgaaagtacagtgaatcttcaagccatctcccataagcttttttcaataaattaatttattgacattaagtttatttacctgtgttctcctgcctcccttaagtgtacgcccaacctaaaactcataggcatattagcatgtgatgaggtccacttggatttatatgtcagcccactgcaggacacaatgtaagcatgaagtctcctatggctttgcaccgtattcaatcaaaatcaagcacagcacattcaaggtcactggtctgaggacttcagagcacctcaactccccacatagctaatgcctcaggtcactctgccagcaaaaaaccatctgctgctccccggtagtgtcccctctggtgaaatatgactcggctgctatagagtcagagacccacacagttctggcagccacttcctgtcacctgccttcccttagtcccagccttggctgtcgagtggggctaagaacacgcacagccaagcacatgggcggggggggggggcgggtgtcgtccaaagctgctgggttcaagtcttggcctcattgctggctgacatattactcacttggtgtttccttgtctgaaaatcacaccaacctcataaggaagggaatgtctgcaaactgcttacagcagtgcctaaggcctgtgacccacttaataaatggcagcttttactgccaccaccacagagccacattattatttaaatgaaaacataaaaagccacttttcaaattagcaaatgtattttttttaatttccaagtaatctgggtaggcccttcaccacttcttcctacatttagtccctttgctaatccacagccaacaaaggtgggcagagaagggaaaggccaactcaaacaaccgggacccttgtgaagccacagtggtgcatctggtgggaaaagggtccgggatgccgggctcctggccacctgcctgattccttcgtggcagacggctgatgggaatagagaagctccaaggagcagaggatgctgattgacactaggcatctctgagcagcccctggcactccctgtgcacagaggtctccatctctgtggtagcacaaaccctaggaagatccaggaactccttgtccttcctgctgcttctcagctgagtgtccttggacaagttacacgaatccttcaagtgtaaaatgtggacatgaatagcacctacctccaaggactgtggggagggtgaaatgaggagcctctaaagtgctctctgcacagtgtatggcactgaaaaagtacttgggaaatgggagccttggtttgacgttacgattattcttcatactccaccacaatccaaatgaatgatgtataactatgaatcattgtggcgcaaatggcttataatttaggaggactcagacctttgggtgggtggtgagggtgaaggaggcactggaacacactctgtcttctttcctgcagcctgcctctttccccgctctgtccctcccatgagcacatgctaactcaggcccctgccactcctggccaagagtcagctgctaaggagacgggggaggaagttctatccttccctcgtgtccctctggacagctgtgaccacaaggggttgcccttgaggagtgaacttggagaaagaaggaaaggattcaaaggggacagaagatgccttcacgggctgctgcgggatctcttctgggcccttggggttaggctgcttcttaaaactcatgtttgtcagaacaaaggatcaaagtcatcagtggaccatgagaaccattacagtgttgggatgctaatgctagccgggggctactaagttgcagaatccaaatttaagtgctgaacacaagacctatcacacagttattaaggttggctttctgggatggctatcacaatttctgtcctgatttacattttacaacgcagcaaaacagaaacatttcccagcctctaagccactagatgggctaaaagccccacctgggagaaaccaggaccctccattccaggcgcccctgtcctggagctgcccaatgaccccaggggctggcagggcccaacttaaaagtgctaagtcatgctgacgatgaccacggaacagcctcaaggccagacctaccttgggaacaaggtactgctgatcagtgcaggccaggacgtaggcctcggcccggcccagctcactctgggggaaatgggcattcatctcgtctccatcaaagtcggcattataggccttgcagttggcatagtggagccgcagcactttctcttcaggcaggatgcgggcacggtgggcctggatggagggtctgtgcagtgtgggctgtcggttcagtagcagaatgtccccattcttcacatgccggcacacctgggaacagagtggacaggtgggtgatcagtgcaaacgtcagtatcaccacggctctttccaagtgctcacctcagcttgaccaaggtgtggcttttgtctcacgttctagttaactaaatgcaaggggaatttttcatctggagcaaaaccctggaaatctctgagaaatacgtcctaggcccttctggtcctggccctttacaaccctgatcctggctctaggctcagaagtataaggaacaaataagaccacaggtctttgtcttcttcagagatgcatagccgtcccaggtttctggattactctgaaaactaatccaaagaaagaaatggatacaactcctgaagatataaccataacaaaatgaagacataaccataaaaccactgggtttgaaaggcattggcagactttcgaatcccccccccgccgtgatcacatgtgagtacattattctaaacagaaattctacatttcacaaaaagtttgcccagcttcatatagcagagccagaaaagggttcttagttagttcaatgccctcagagaacactttattgcacttcaaaaattaagagctgtaaattgtcatagtcttttgggaacagagtttgaaaatagcaattaaaacacttaaaacacattttctgttggctcttcaagaaaaaaaaaagcacccacacaaggttagatgagtatgtatgtttgtgtagcagcatttacagcggcaaaaactagaaataacctgactgccccatagaaggggcaatagtgtatccacactatggaatattatgcagtgatgaacaaggataaggtaaatgtatacaaggcctaaagtgatagcaataatgtattacagcaaagaaaaaaaaaacccaggtggcatgtgacatgatgaaaaaaaaaaacaatttaaaaaccaacccagcttctctctctctccgtgtgcatgtgtgtgtgtgtgtgtgtgtgtgtgtgtgtgtctatgggaaaggggtggttggatcctcactaggctgtactatttttctgagacagggtctctctctgttgccaggctggagtatagtggtacaatcatggctcactgcagcttcaaccttctagcctcaaacgatcttcccgccttggcctcccaaagtgctggaattacaggcatgagtcaccacactcagctactttcctacatcttagcatcgttcttcctataatgagtatgtgatgcttctgtaaattttaaaaaaggtcttcacttatttttaaagaaagaaatattgaacaagtgctatgctcattgctagagggaaaacagaaaatacaatttaaagataagaatttaaaaatcacaagtaattgtacccctctaagataaccactgctcatacttttccccccttataaatatctggctggtcatgtccttctgacagacatctctctcacaaagctgactttcctgtaccgcctattaagacacttaccacccttatctttaattatattaactactgggcctcctaaacactgaacataaagtgacaccttaaaagacaaatgtatgaaggtaactgccaccccatgcatcctgaagggctcctctaagtagtacaaaggaattatgaagacttggtgaaatctctgccaccccaaatctcctctaaatcacaacagatagcaggcaggagaaaacaacaaattattggaagtctagtttcttcttatgttgcccacatttatgaaactgcattagaaagttcattaaagagagaggctagaagtaattaagagatactccccaaaactctctccccgattcctgttcagtgaggttaaaagttttctctctctagctcagagaagcagggagcaaaaccctcaagtgctacaaagcaatcttaaaagtacctagcatggagtccgtctttttgctcccgaaggaattcaaaccttcccctccccattgccaagtcccatgtttccaaggagacctaaactctgagggttcccatgagcatctgcccagggcactggctgctgtctgactgcgtcatacaagctgaggtcttcttgctttagcctctcaagggagaaactgcctagacctgtggcccaagcccaataagccaggctgggcctaggatttgagtcttgcaaatttgagacatcctccagcgtaagcaaactcgccacagctgggaaggtacacaggccagtctggtaggcaccggccaatccaaacagaagccctggagcacagggtattccccttgccaacccaaacccaaggcccttcctttctcttgtctctaaataaatactgcagtgaaaattagcgtgccccagtgccccagggtcagaattttcagaggcaggctcggagccaaaggcctgcttctggcaggctgctgagcagggcaatgagccttggctctccgggccatttcctcttttatttacaaggcccaggggatggggcagagctttcatacttcatagaggaaatgggtccttttggcctttcccctcctcacctagcctgtggttcctccccggacgagacctcagtgtttccttcccatcaacctcacacagccccttcagccttgccctgacccatatgcaacacattaaccaaagtcttcaaaaattacaggccaggagcagtggctcatgcctgtaatcccagaacttcgggaggctgaggagggcagatctcttgggcctaggagttggaaaccatccttggcaacatggtgaaaccccatgtctacagaaaatacacaaactagccacacctgtggtcccagctactcgggaggctgagtcagaaggatcacctgagcccaggaggtggaggctgaagcaagctgtgattataccactgcactttagcctgggagacagagcgagaccttgtctcaaaaaaaaataaaataaaaaaaaaaaaaatgacaggttttggtgggtagcagactacagtcctcaggctggccacctgcttctgtaaataaagtttgattggaacacagccatgcctatttgtttgtgtactacctgtggctgctttggtattaggtggcagagctgagcagctacagcagagcctgcatggcccaggaccacagaaatatttactatctgaccccagaggaatgagggcttgctaaggcctgagagagcagcaagaattcgctgccttcagtcccctctttagccctgaggctggccccagcacctggctcacagttgcctcctgatgaccccaaactctccctgcccacttgccctgcacattcccctcaaacttgtttcttcttggacattatgtgcttaaagtcactgtctgtcactgctgttccctatggtgtctaccacacccctccgcaacagcaatacatttatatgcttacttcctagtggttcccccaccatgctgtcaactccagggtggcgaggatccgtctgcagggactgcaaagtgctagcatgcagggggcatcagtactgcctcatccctcaccccttctcctagtctctttctcatcctttcctattgtgagtctgtttcacatgtttgacctgagttaaatgtaagtgaagtgaaacacaccttgcttctttttgcattgctcacacagtgcctagcgaaacaccaggcacttaggaaaggcagaccgattctacgaacctgaatacaaaccttacttcgtgcactagagaagaacaaaagaggtgacttgatctatgtttgcatgtgccctgtcaccaaaggagaatacagtaatacaggcagtgtattactgctgcccctcaggacggcggtgagaacgagaggaagcaagaaggcctgtgatgagcagtgatgggcaccgccgcaaggccaggagcatttccttttcctctcggttcctccaaagttccttcaaggctgatgcaactttgcagaggtgaactcagtgttaaagaagggcaggtcagccatgggtatgggtgggcagagggcaaggagaggccctctgtgcaggtgggtgaggaaaatccaggcagtcacctattgactccggtagtcacttgtgggttacatccaagtcgaatccatttccctccaacaactgctgccactgttgcctagttaggggtcatctgctactcccctcccagcaggaatggctattatgtgacagagccacagagctgtcacctgctgatttcatgcactcagcaacattgttaatcgatcatgtgctccttccagtggaacctgatagagcctcaggattccctaccacagcactatgggctagcattagcaattgcccaaaatggaaacattagttataacctgttatttgttggttatcactggcacagagcactcccttcctaagagtggctctcaaacatcagcatgcagaagaaccccctggaaagcacggtaaagaaagattctgaactctattctcagagattcaaattcagtagaggtggggggatgtgcattgctcacaagctccagggctgctgctgatgctggtctggggactgccctttgagtagtcctgtttaagggcagccattcttctgcccggagactacaaggtgaatctaaaaagccacccacgtgtcggggagcttcctcctagggatgggctcctgtgtcagtgcgcaccggagccacacctgatggccaccaatcaccagaatccgaacaggagccggatgggtccctgaccaaagctgcccttactcacaatttttgtcccctggggcttaggtgcccccgtggctggggtcagaagctgcttggccacggcctctcgctgggtcatgtccacagcgctcagggctgtgcggctgccgtcctcattgatgaccatggaggctcctgggtgcacattagggccgttgatgaccgcttgcctaagttcctgaacattccatggggtaactggctgtgggtaggtcagttttgtggcaaacacctggaaatgaggaatggaggtagaaattcagggcagggataaaaaaaggtctgatggaccccaaatctgtctcaacaggctgtcttttcacccaagatgtggaggagctgtttgacttggccaagaaggtcttccagtgagcaaagtaacatcctgcctgtcttctgctactcccttaatggtatagagactaggcctccttttctaccagttagtctgaggagaataatttaagcgcagcagtttatataatttttttttctttgagatggagtttcgctcttgttgcccaggctggagtgcaatggcgcgatctcggctcaccacaatctccgcctcctgggttcaagcaattctcctgcctcagcctcccgagtaactgggattacaggcacacactaccacacctggctaattttgtatttttagtagagacagggtttctccatgctggtcaggctggtagcaaactcccaacctcagctgatctgcccgcctcggcctcccaaagtgctgggattacaggcgtgagccaccgcgcccagccaattttttcacccagtctaaaacttcattttcttatctgccaataaattcaaagttcccaaaggtggcatggggcacttccttgagacaggtggcaaatgcctgtcctcaaataccctgacatccctcatctaccctggcagacatcactaatgcatcatggtgctgtccctgagcccagacatggcatcggaatatctcaactccacagttctggcagccattacaatcaaggtggtacttgagatgaaactgacgcattcctctgatacctaagaaaatgcagtgtgctgtgtttaaagctgggcctgggatacgctccaagtaaaacaagttccctgttaaatgagtttttgagctactgaatattataaacctctaatgcttccaaatgtacacaaatacaccagaggctctgagatgtcctacataaaggaacttgtctagctttgtacaggtcccgcgcagcaacactttctcagaaggctcctggggctaccccagcctctgcgttcctcagcctgagcctgctctactgttgctgatgcacttaccacccatcaccgttcaacagagcatacatatacttgtctatctatttactgtctgtctccacccctggacactgctttatatgggagcacattagtctgtgcttcactgctggtctccagctccttgctcctgtggcacctgtcaacagtgctctatgggaagtgtgtgatccaaggggccagaggcagttctatccactctaatcttcccagctatcctgtgaggaatacctacgccccaggccaccatggccctgagacttgcagcagtctgcaggtgggcagagaagtgacttcggggtctctcctccagggacaagccactaccaaacaaacccagatctaagaaagagaacccagcacctagaagatagaaaaggcagcacaaaaggtctctcacagagctggggacactgtaggcactatgaagtcaaggccaacaagggtggcccctgccctgtccagagagggcaaccaaaagttgctacatgtctcctcgggacctcagatttgggaatgtcaccactggactttgcaaagctggtcctcaccacatgatccagcctttgaatgcaaggactatggttcccaagaggcagtgggtacaggactgggccttctcagactgctgtctcctgacacatcacgcctttgtccaggaaacccaagtgtgccacaaagagatgaggccatggggacacaggatgatcagaaagaacacttcagcgctgctcatcaccagtccccagagaggggtggagggggtggcgtgcaaggaaatgaggctctccacggagggaaattaaaccaccttcacattactgacatagaggccggcccattaaggaggaagccgattaaaggctgctgctgctgagcaccacagcatgaagtgctaaggatgtgagaagacgaagctagctcccggagggggtcggggggagagcactaacaggtgaacagcaagctgctgaccctgagaagcgaaacaggacctgggcaacatgcacacgcctctctccgggactcactccctttcctcttcccagtaacctggggtacacatttctgatgcctggaaagtacacaggactgataactgatatgccccatgccctcttcctctcccctgtcatgtattcaatttggtgaggaaggtcaaaagactaggctgaagtgggcaggaggaagctatgccggcggggatgtggaacaccctgcagtcagctccctggtgctgacttgttggtaggaggtgtctgtaagcctagcaaggagtgacagcaatgccatcatgcagcttccagtcacctccttgtgggctgtccaggaagaggcagaagctagttccgcccaagccagaataatctgctgcacatcctgtccccagtcctctgcggcattctcatctgccacccacggggagcaaatgagccctgcacgcgcgcgcgcacacacacacacacacacacacacacacacacacacacacacacaccatgggaattccaatttcgttggtgttgatgtacatgtctgggcagatgactgagcgcgcagcgtagtccactcgctttcccatcatgtgttttcggaacaggccttctttcttctccaggatctttatggagaaaaaaggtcataaaaaacattcaacaagaattccagtaggcttattagtttcttgtttcaatacacaatgtttattatttatcttctgtagctagcaatgggaatccagttttttgctcacctgcctaatgcctgggtacttgtccatcattagtttgtccatctcgctatcaaacacaatattgacgtggctctgaaggcgaatccaaatgttgtaaagtttgtctatgagggactggcctggaagtgtactcaaaaaggatcggtcaatagcaatcaaagagtctttttcctggaagatgaaaccaagaaaacagggatgatggaaaaaagctccaaaaggcctggcttgatttaatttttctttcttaccctggatctgacaactatgcactctggagtttatctcctctgaacctgacagatcagagacaaacatgctaataaatcaatcttgtaagtacatgtcaataagacatatcagcactattatatatttaccagcctgtctctttctagtagtaagatgaactcaaaatttataagcatgcttctttcttaaggcatttttgctgaaatcccttaatatgcaattcctaaagaaaactaagaagtccttcccacatcagtacatttcttatgaagttctgttatcttgccagataaccaattctcacatgcagtttcagttttatttatggctttgaaaaacttgatccaaaccaattacaaacatgcaggtggaacaatttcttaaaaggaactaggtttgccatacgatattctatgtcatcaactaagatgtgggtctccagctgagctatatcaagttagtggctgattgccaagtctcattggaatatttaaccaatccttttttaatatttttgcccctagccctgtctcctcctctctcccactccctacccaggggacagaaatacacagaagccttcagctggcttagagcaccacctattgatactgtctggccacctactggcccaatcgactgggtatgacacaaggagacagatggtcccacgtcttccagtgtgggcagataagagaagaaacctgtcagtgtcttgaggtgggagggtgagggtgggtgaagattcagtaaacgagaatgttatgaaaacccagtagtgatgaagtgggcttgtcatcaaacctgaggaacacaggaatcttctttagctctagggaaaatagatgtattctacataaaacactcagggtccccttctggctggagtcccagagggagatacgatcacctgcatgatgaccgggccctgttagcccaactcactgctcatggcattacctggctcaagaccagtgattgtgaaatgagtgagaacttgtctcactggagtatccccaatgcctagacggtgactggcaagggctgccatgaggatggaacacagagagtaaggggggagaaaaaacacatcctgtcaatcacaaggaaagagggcagtgggacataggaatcagaggatgctatttgcccctcagaggcgaagcatttgtttgacaaaggggacgaccaatttttcttttttttttaattattgagatggggtctaactctgttacccaggctggagggcagtggtgcgatcacagctctctgcagcctcgacttccctggctccagtgatcctcccacctcagccccctgagtagctggcaccataggcatgaaccaccatgcccagctattttttgtatttttggtagagacagggtttcgccatgttgcccacctggtctaaaactcctgggctcaagtgaacctcctgcctcagcctcccaaagtgctgggattacaggcttgagctatcatgcctggccaggctgcccgatttttaagggacatcaaccctggtcactgggtacagttatcccatggtcttttcttggaaactgcactaaggcatgcacatggctgatgtcttttacactaaggagtttttaaaagcacaccaatgcgggccgatcaggaaacaagcaaaaccacagaaagccccaagtgtaacctgcaccataagtgtccaagagacagtggcgccaccttgtgatgggcctggcagacagcgggactgtcgcagcggctggagtctgagaacccggactgtctacccaaggctgcctatttgcatccagagagtactttagagctgggaaggatcttgatgacctcagcaagcttcctgggtgcccaattcacctttgtacccactgaacacctactaattaacccggcacacagatggggctcaggaaatgttagttgaaactgtcctattctgagaggaatttccactctgcaatactgccttcctgaccccaatgctggagacattaacgtgtccaaaatagagctggcaacatgagctctagtactgtgacccaaaagggacactcttaaagcctgagggaagtaggctattctttctagagctgcgagagctggtagcccggaacagcctaggtgtgaaatctcaccacaaatcacatgcactttatagcagacactagtataaggaagtgactcaactagggtcacctggcatggtcgttcggtgtagaagctagaccagaacccacacctttccatgctcagacccatgtgtgtccccctaatgttcctaggtgccccctaagcccagagctcacactaaggctgctgccagctgcacagaacatcccaggaagcatctcccagacccagtgtctacatccacagctcacagagttagcactaagcatgtgtgctcatcacatcagcaacagagcagccctgacctcatctgtagtgggtgtggccacttcctctggcaacttctgttcttgggccatcaatgccagaagttttcgaatcagaactacatccttcatgacagcctgcaagttcaccgtctggccattagtaaacatctggtctcctaggcgactgactgggcgatacctgcagggggacatacggaataaatgaatgtttagtgtgaggaaagggtcatgttcttcagcctctcacccatgcctactgtagggagcacaccccaccatgctcaaaacaaccaaccttcctaaccaacattccggctgggtgtggtggcttaagcctgtaatcccagtactttgggaagccatggcaggtggatcactggaggtcaggagttcgagaccagcctggccaacatggtgaaaccccatctctatgtaaaatacaaaaattatttgggtgtggtggtgcgtgcctgtaatcccagctactcaggaggctgaggtaggagaatcacttgaacccaggaggcagaggttgcagtaagtcaaggtcatgccactgcactccagcctgggagacagtgcaagactccacttcaaaacaaacaaacaaaaacaaccaacattcctattgcgttcacaacaaacgggaaggaaagcaagccctcccaccacctgcacctggagcggaactgcagctttgtctctcagtgcccttggccctttcacctctcctagaggtcacatttcagttccttagtacgctttttttcaggtgaaataagttaattaaagggtattaccttgagggcggcaccaccaagaaatctagaaagaacacactgggattgaatctggattccataccatcatcatccattcccgaaaaaaggtagttcagaaagaatcctgcgttggaaagaaataaaccaagaagaccatttaaatctatcactaagggcatgggaggacaaccataaaaatattactgagtgaggaaaaaacagaatacaagataatatgtagagttaaggtcacagttttcttttttgagaaaaggtctcactcctgtcgcccaggctgctgtgcagtggtgcgatcatgactcactgcagccttgatctcccaggcttaggcaatcctgccacctcagccttccaagtagttgggactacaggtgcgtgctatcatgtccagctaatttttgtatttttttttttaagagatgaggttttgcttggttgcccaggctggtctcgaactcctgggctcaattgatccacctgcctcagcctcccatattgctgtgattggaggcatgagccaacgtgcctggcctcatttttctttataaaaacaaaaaatagcccctgtgtacatgacagtttgtatgcaggggatatgatagcataaaaatgggtactacagggacaatagctcttaaaccagggactgagatgggcaaggatggggaagaaacttcacttgtttttaatcaccctcctggactattaaaacacagacagcacacacatcattactttgatcttcataaaaaatatgttgaataaaaaaatttttttttaagttagcctcctcccacccctaacagttactgccaagaaaggatcttctgtggatcaaagctttatttcaggtttctggttactttaaaaaatgcctagagaaaaagattaaaatgtactagggcctgccacagaagcaatcatactaactccagtgcttttttttttttctgatacctctttaacaacatgttcatttgtaagcgcttattacacagaggttatagtcagcgttccacaacatactctcacaagggcttgaatatactgcgtaggttttgttatacactcaaaaggaaagaaggatttcccttatagtaaagtcccaatttaaataagacagagttcattctttgattcacagaaggacaaagcattttacttacgggcatttaaaataagttacactgaaccttctaaaaatatgccaacctgtattaagtgaggcccacctgcagttgtcatttcataaccaggctcagctgcgataattgtcaagtttttggtgctgggtatgacctctcctgctctatgactcaatgtcaatgtgccctgaagactgccccaaacctctggatcagttccaggaggaagctacaatcactacaacttaaaagaagtaataaggcagggttaatgagtccaggaaataaaagcctagagaagatcaaggctatttctttagcctgatacagcaccttcattcttccacagggcagaaaggtgttcgcgggcactggtgggtgttaagtatcctcgttttcctatctgagcttcctcaattcctggagccaaggaggagaatcaaagtgcaataaatcagaaacaggtactctttctgcaatgggatttatcaattctttatccccaagcctgcaacttgaccacaaaaatcaatctcaagggtagcatattatcaggcctggattccctctggcccttaatctcatttctatagtaataaaaaccatatggctattgtataaaacctaaaaaaaaaaaaaagcaaagtaaaagaaaacattacccataatcccatcacattaacaactcctatcacttttatatattgttttccaggcctttttgtctatacacgtattttacacaactgtaatcttcagtgtggatttattttgcacactactttgcccttttagtatcatctcatcagcatgtctgcatgttgctatgtagcttttgcctgatcaccatttttcatggctatgtgatattccattaaggatgattcctaattcacttaaccatattctcataattggacatctggattgatttccatattttgctattataagtaacattataataaatatctttatctacctgttttttaccagaaaagttcatataagttgaattatggataaataagtatttttataggtaaatatatactgacttctttttacaaatatcatactggtgtgtgaggaatagattgggcttggtttctcacactaagcaagatcactctgggatgccatctaccagcaatacccaggttacatgagaaaacgaggcttgggactgccattcaggaggtagggaccaggcatttaagatgattacctaagacaagtaagtagtgtgtctttcaggttcaaaactttctgggcactttgggaggccaaggcaggcagatcacctgaggagtttgagaccagcctggccaacacagggaaaccgtgtccctatgaaaaatacaaaaattagccgggcatggtggtggacgcctgtagtcccacctactcgggaggctgaggcaggagaatggcgtgaacccaggaggcggagcttgcagtgagcggagattgtgccactgcactccagcctgggcaacagagcgagactccgtctcagaaaaaaagaaaatactggacatgactgtaatcccagctactagggaggctgagacaggagaatcgcttgaacctgagaggcagaggctgtagggagccgagatcgtatcgctgcactccagcctggatgacaaagtgagaccctgtctcaaaaaaaaaaacacaaaacaaaacaaaacaaaaaccccaaaaagcttttctggatacatccactgaaactaagcattactcaatgttccttttttattcacatatcaggacaggcactatgccttgtctgtgttcctaacacttgacagggtgtctagctcacagcaaattctaagttaagagtatacggctcaaatataaaatagcctaagatagtctacacttaaaaacaccactcttgccttttcctttttttttttttttttttcaagacggagtcttgctcgtcacccaggctggagtgcagcggcacgatctcagctcactgcaacctccgcctcccaggttcatgcgattctcctacctcagcctcctccatttttaaaaactagcttcattccacctccaattctccagctagtttctttaaaatctgcagaggatatgtcatcataagtttttagagaaatccctaacttggagaacaattaacaaatgcaccataatttaagtagtctctgttaataggtatttaagtcatgtccagtattttctttttttctgagacagagacttgctctgtcgaccaggctggagtgcagtggcacgatcttcgctcactgcaagctctgcctcctgggttcacgccattctcctgcctcagcctcccgagtagctgggactacaggcatccaccaccacgcccagctaattttttgtatttttagtagagacggggtttcaccgtgttagccaggatggtctggatctactgatcttgcaatccgcccgcctcagcctcccaaagcgctgggattacaagtgtaagccaccgtgcccggcccatgtccagttatacactattcaaacaacactgtgagtattctaattccttaggataaagtcatcaaagcagaactgctaagtcaaggagtctgcatgtttaaagttttgatgtcgataaaagcagaatatttcaatgagttaacgcaactgaaggaagcatgggtatgcaatgaagaatggccttgaccttcagggataaccacagcattagaaagctacatatgttcagtgggagaaaacagaccccattaacctgcattttgtgggcatttctgaaaatgagtgtctgaactttctcttctactaaataggttggaaatgctgaagaagatcggtcgaatctcctcagctcctgtcccagcaatgcccccactgcagtttagtcaccgtgaaggcagaggctgttcttcaatcacaggatcttaaagtcagaagagagctgtggaagcccatctcctcacatgcgctgcatcccctcctaacaagaacttctgcagcttgcaacaatgccttctgcctagctgggatttcagagcatcttgaatgtgtctttctttcagctgtaagaggtgccataggaaaaagggattcagaggtcaaataacctgggatcacaatggctggaagtgtcttggctatatgaattctcattttaaatgttaatgtgccttgtggggctcaggggggcacatggagcacagggagcgcactggagcagcacgtgtggcatttcacaagctgacagcgctccttgtgggatcaccagtccatggggactactcaggcacagccctcacttttttttttttctttgagatggggtttcgctcttgttgcccaggctggagtgcaatggcacaatctcggctcactgcaacctccgcctcctgggttcaagcgattctcctgtctcagcctcctgagtagctgggattacaggcgtgcgccaccacacccggctaattttttttttttttagtagagacagggtttcaccatgttggtcaggctggtcttgaactcctgacctcagatgatctgcctgcctcctgacttcagatgatccgcctgactcggcctcccgaagtgctcggattacaggcgtgagccaccactcccagcctagccctcactttttgattccctctgataccaggaacatggtcagacccacgctgaggctgctcactttcctccacatcacctgctccccagggttactgatctgtgtcacttgcagccccttcagagagcagagaccacatggtctggtctgtgtcctggcattgtgctcatcacaaacatggtccttggcataatgctgagcacccaacaaataaatgtgtgctaaatactgaatacccaagcctggagctgtagaagactatggtctacttgtttctaatgcacagacttttggttgcaccatcatatttgcgtggctgcaatgaaagatgactttagaagaatgggtttggtgaaggcattgaaaggctacttacctgccggacatttgccccacgaaaactatcttctagaaagaattctgaccatctttgttctcaatctatgaacattttataaggcatcctaagggctacagaagcaattcccaactggtaatacaagaaaattgttttgagggcaatttaatggttaagtgtaggaaaatccactcttacagtgttaactaccaaccatgaaacaaaattaaaaaggctttctaaatgcagtgtggtatcctgggttggatcctggagcataaaaaggaaattactggaaaaccagcaaaatttaaaaagtctgtagtttagataatagtgttgcaccaatgttaaactcagttttgacaaatgcaccatggtaatctactatgttatacagtagggcaaatgaagtaaacagtattaaggaattctctgtactatgtttactactcttctattaagtctaaaaattatcctaaactataacattttaaaaaaatattaaacaggtttttcatttagtccaggccatgccagagtgttcaatgtaaaacatacatcatgcatctccaggaggggatcttatttccatgcttatcccatattctcaaaccctggtgaaaggtttagtaacagtatctgctatggactgccatgcatgtaacttcctcaattctaggcaagaggctttaggaatgccattatatagagttagaaatggaaacgcctcaaaacagccttctatctgccactcagaaaaagtggcagagccaagtgacaattgcaggttgtgctttttctttctttttctgagacggagtcttgctctgtcacccagactggagtgcggtggcacgatctcagctcactgcagagtgcgcctcctgggttcaagcgattctcctgccctagcctcctgagtagctgagattacaggtgcccgccaccacgcctggctaatttttgtgtttttagcagagatggggtttcaccacgttggccaggccggtcttgaactccagacctcaagtgatctgcctgcctcagcctcccaaagtactgggattacaggtgtgagctaccgtgcccagccaggttatgcattttctaccctggaacactgatgacataataagaaatgaacagttaacatttacatagcacatattacacagcaggtaccgctctcagtgcttctcttggaatactctatttaatcttctgaccacttcagaataaaaaccaaaaaacatttttaaataagcctatgactataaaaattaaaaagtgggagtattaagttatctcaaaatttttcccaagcagagcttgggtagggcagagctgaggaaagaattctacctggggggatctgggtggacagccaggagtagcctgcaggaggcgctcatgttttgctgaattcttgcagtttttcttaaaaattattcgcctacattttattccaaaatagatccacacttgttttacagtaaaatgtttcaaaatatttgtcaggtaaatttcttaatttcttcctgaaaaacctttcagaaaaacgaccacctaaggcaagaggcgcctgtggggcactgcctcataaaacagcccctcccatcagctctcccatgtgagaggcctgagctgggcgcttgccagggtcccctcaggcctgagaggcctgcacactgtgcctctgctggcccctcccaaatgcagcagagaaacacgtggtgaggagaaccaggtattcccagggtttaggacacatctgctggcctcacatggagctcctctccagacccagcctgctcacccaggggctcagagtccttctggccagctgtcctgtgcaccatggctggaaacgtgatagtcaacttgctgttgtgttcctttcggacaacggatcgcccggtcctgtgcaggaggacagttgtgattgaagagagaaaaaacccagtaagatatttaataatagcaatgagtgactgcccagagacgtctcacctggcgcaagggccctgatacttacttgcagtggggacagcgcttagcattcatatgtgccttccagaagagagcaatgagcttgctcttgctctcacacacgttctttacctgtttttttaaaaaaagtcagagaaccttggagtgccattttgaagagaatccaatatatttactttatggttttcaccttttatttttaaccagcggaaacacccccaccaccactttcttaaacaaaatcttccatagaaccctaatacacttgagctctgacaattactgagtgacttctttaagccttcagtttctcaattataatatgggaataagaatagtaaccacctcagtaagctcttactaagacaaagaatcatgaatgcagtgggggcttgaaatacagccagtactcaataagtgctagttactttcacttgtaaaaggaagccctctggatgcagctggcctgcctcagaaggacctcagggttctaaggaaggcacatccacagtccagccacatgagtggctctgcacctggcagcagatgggaatcatctgggagcttttgtaactccacttggaccctaccccagaccaattaaatcagcatctctggtgtgaaaccaaggcatgaagtgaagcagattccaagactagtatcacaggtgaattatctacccattcattcattcgttgaacaaattaatacttaggcagtatatgaaggggagaataaggtagcagtgggttagagagaagtgttggagaaggaaaaaaagacctgctgccattttttaagaagaggcttgctggatgctataccgaaatcatatgtcacataatcctctcattggtcctgcaggcaggcattagagattagatagtggacactcagggacagttgtgtaatttgtgaggttgcaggtctcacaagagacagagctcagatgcaaactcaggtctactttgggaagccagaagtatatgcaaaggacaacacagagggaaagtgataaaatgatgcccaaaacagcatgggagaaagacagtgttaactcacatgtgcgccctgggaccccaggaggttgttctgcacaatttcagttgtgtattgttctaattcctcccgaatttcagaggcagagggatcgggattttcttccagaaactggaaaacaaagaggaaaactccattatcacagtaatgtacacctctgatgagcagcacaactgggaccaacctctccaagggtggaaaagattcatttgaagggagaaaaagaaactatggctactgtgttgcactttcaaaagagtgagacagcatcgctgttgaaaaaaatcaaacaaggtcaggcgtggtggctcacacctgtaatcccagcactttgggaggcagaggcaggcggatcactagagctcaggagtttgagaccagcctgagcaacatggtgaaatcctgtctctaccaaaagtacaaaaacttagccaggtgtggtggcatccacttgtggtcccagctacttggtaggatgatgtgaggagatcgctgggaggggaatgttgcagtgagccaagattgcaccactgcactccagcctgggtacagagccagacaccatctcaaaaaaaaaaaaaaaaaaaaaatcaaatgagaacatcctacgtccaataatggtgggctagattccccagaccaaacctaagactgcaaagagccaagataggttaaaatatttttaaaaccttaatgttctgaagagccgacaggacagtgaggaataaataaccagagcaaactaaaggggaactaggaatctagcaagatgaaagagcatgcagccacatgcgctgatgcagggctttggtgctgtgctgaagcaggacatcacttggtatactcatgtgccccagggaatatgcctatgatgctccccaggagccctggccttgagtgcattttccaatgcagcaattttgaactttttattcacaaactctcaaatgatgtaggaaacagaaatgaaagtcttaacctaagctgggcacagtggtgcctctgtagtcccagctactccagatgctgaggcaggggctcgcttgagcccaggtgtttgaggctgcagtgcgctatgatcgtacctgtgaattgccactgcactactccactgcttgcctaagccacacagtgagatcctgcctttaaaaagaacaaatttaaaaacctaaagcttttttagtataaggttagaaatctaacaggaagccatcattcttcaccccccaacacataaacatagtaagccggaacacaaaggactatactctcaggaactaccagcccttgtacaatcactcaggccatccagggagctttaagcgttgaacctggataatgacagtcccaagttggcatcagtgccatgcacacagcagaagcaatgagaatcttctctggagaaggcagcgtcatcctagccctcaaattattcccataaataatttttatttttacatttatttttataattattagaaaactagagatagcatcttgttatgttgcccaggctgctctttaactcctgggcccaagcaatcctcccacctcagcctcccaaagtgctaggattacaggcattatccactgtgtccagccccaacaaagaatttttaaaggtcaatgacagacaaactgtcaaaaataaatacacaaggggacagggaaaggagggagggtttttggggacataaacaatatgctgacattgaactggactgtaagggtgatagttactttgtattggactgtacatataattaatgcatttctgtatatattttacaaaaaaaagtttaaggtataatagtaggcaccatgaataattttatgccaataaatctgaaactttaaatgaaatggggaaattcctagaaacatgtaacttactgtgagcgctggtttaagaaaatcctttctttctctctctcaatctgtctttcggacaaatttgaccatgagttaactttttagctctgttccctcataaatgcaataaaagtagaaataggccgggcacggtggctcacacctgtaatcccagcactttgtgaggccaaggcaggcagatcacctgaggtcaggagtccaagaccagcctggccaacatggtgacaccccatctctactaaaaatacaaaaaattagctgggcatggtggcgtttgcctgtagtcccagctactcaaggaggccgaggcaggagaatcgctttagcctgggaggcagaggttgcagtgagccaagactgtgccactgcactccagcctgggtaacagagcaagactctgtctcaaaaaataaataaataaaaataaataaataaaagtggaaatgtcagttgtgttattaggcaacactactgatggtaaaaatgaccccaattggttaggctacatctggactggaaagactacagctctgagcttccctgggtcctagctgggcatatcctacggtccctggaagcacagcccatggaactgttagaaacgatattgattcctttctgggagatggggcctctaggccaggggggctcccatagccgctgatgtgatctcgttcctttgcgtttgagcagtcgtctgtcatgtggggagccaaagacaactagtccctgtgaggacacctgctgaagagaaatgtgtgacactgccctgctggcatactatgtctccaatctcctccagggcgttttaaagagagaattatctaactcggctgggcacagtggctcatgcctgtaatcccagcactttgggaggccaaggtgggtggatcacttgaggccaggatttcaagaccagcctggccaacatggtgaaaccctgtctctactaaaaatacaaaaattagctgggcgtggtagcatatgcctataatcccagctacttgggaagctgaggcaccagaatcacttgaacccgggaggtggaggctgcagcgagccaagattgtgctgctgcactccagcttgggcaacagagtgagactctctctcaaaaaaaaagaaagaattatgttacttattttatgaggctgacataatctagataccaaaacccaaaaagacaataggagaaaggaaatgtaaaccaatctcactcatgattacagaggcaaaaatcccaagtaaaatattaagaaatcaaatccaacaacatattaaaaaggtaatatatcataaacaatttgggtttatcccaggaatcccaggttaatttaacattaggaaaggaatggagtcattcaccatgttagctggtttaaaaggagccaaattatctgaaaatttcagtatatattgaaaaggtatttgataaaatgtaatatttagccaccacagcaaaataggaatacaaaggagcttccttaatccgattaaaagctcagtaaacaccatacttaatagtgaaatgtcgaaagggttccctattttaagggtataatttatttatattttgaaacaatctcaaatttatagaaaaattccaagtatttccagaaatctatctttcttgaaccatttgacagtacactgctgatctgatataccaacaaccccaaatactttggtgaacattttctataaacatggacactcacaaatatgaccgtgatacgatcatcaaaaaatggtaacttagcactgataaattattaccttctaatcctcaaacaacattcaaattttgccaactcctttaataatatcctttacaggctgggagtgatggctcatgcctgtaatcccagcactctgggaggctgagccaggtggatcgcttgaggtcaggagttcaaggccagcccggccaaaacagcaaaaccccatcttgactaaaaaaatacaaaaattagccgggtgtggtggtgcatgcctgtagttccagctactcgtgaggctgaggtgggagatcgcttgaaccccggaggcagaggttgcagagagccgagatagtgccactgtactctaacttggataacagggccagactctgtctcaaaataatactaatgtcctttacagcaaaagtatccagtttagagccatctgttacactttttagtctcctttgtttagaatagttccttagtctttaactttagtcattagcagttttgaagattaaaggcaagttttatagaatatccctcgattgcgggcatgtctgatgtttcctcatgatcagattcggctaacacatctttggcaggaatatccagaagcgatgttgtgttctttcaactggtcccatcaggtatgcttcactttgatcacttgaataaaggggtgactgccaggcaagaagtcttttccatggtaaagttattctctctctctgacctttgtaattaaaaaagactatgtgtgtgtatgggagggagggtactttgaaagtgcgttagtagcctgttaaactttcagtcactcaattcattctttcatttatatcaacataaaagtaggttcatggattcctactttattcaatgggttataatcacttagtatcatcatttattatgatgctcaaactgtcctagatttggccagtgtgggcccttcacacaggcttttgtgccctttggacatgtccaatcgttctttgagcacatacttcctttctggcatgtgacattccaggctggtcttgtactttctctgtcccagctctagatcagctatttctccaagaagcttttttagtggagaatggtatttagaaaacaagaagggggtgctaggtgctatcactcctctgagccctttcagggacagggccaggggaaaatacatgtgtacacacactttacacccgaacttttaattccattttaacaatacaggattaattctgtcttctctctttcatatatttgtaactctcttctctgatagttaaaacctggcccccattatccttaagtatgtattcgatcaattaagtacttattcatcaacatctctctctctccccgtatgtaaccactctcccaccactgccactgtcatcccctcctcggtgtggagccctcacccaaattgggctcaagctccacatgagcccaccctccttgtggacccctccttatcatatttgggctcatacatcccatgctgggtcaccctgcacaggcaccctctcacctgatttgggctctcacactctaagctgtgcctttatctccaaatgaacatcctccttaccctattcgagctctggtattccgcacagggctgcccacatgtgcagggatcccctctcactctgctctggctgagtccctgtgcagggacacccttcccacgaagctttgctcactctgctgtggctcagacaccacatactaggccatgtctctttggggaatcccagcttgctctgcccacctaatgtcttcgggactgaagcatccaagaagagggaggagaagaggaaaggggaacaacttttctatgtgacaagaaataagacaaagatacccactaccacttcaacacagtaatgtagatcctagccatcaaaagaaaacatacaaggcttggaaaggaacaaaaaggccagtatttgcagataggattgtattgaaaatctaaaaatatctacagataaactgtcagaattgatgagacaattttgccacgttgcttcaaaaataatcaataacatttttacatatcaacaaacaaaatgaaattttaaataaggtatttttaatagcaccagaaattctaatgtaaatattaactatgaaaaagtatctctttacaatagagatctggtcatccccactttatccaaaagtaaccagccagagaaattaggcaagagaaagaaaaggcatccaaactgaaaagaaggatgtaaaaatgtccctgtttacagattacatattcttttctttttttttttttttgagatggagtcttgctctgttacccaggctggagtgcagtggcgcgatcttggctcactgcaagctctgcctcctgggttcacgccattctcctgcctcagcctccggagtagctgggactacaggcgcctgccaccacccccagctaatttttttgtatttttagtagagatggggtttcttcgtgttagctaggatggtctcgatctcctgaccttgtgatccacctgcctcggcctcccaaagtgctgggattacaggtgtgagccactgcacccagccgacataatctcatatatagaaaaacctagactctaccaaaaacctcttagaactcataaacaaactcagtaaagttgcaggataaaaaaaatcagtagcacttttatacacaaacaatgaattagctgaaaaagaaatcaagaaggcaatcccgtttataatagctaccaaaaaaatacctaggaataaatttaaccaaggatgtgaaagactcttggaaaactgcaaaacagtgacgaaagaaactggagaggatacaaatggaaaaacatcccatacttatagatcagaataattaatattgttaaaattactacactacccaaagcaatttacagattcagtacaatccctatcaaaataccaatgacattctttgcagaaacagaaaaaaaaaaattgtaacatttgtatagaaccataaaagaccctgaatggccaaagcaatcttgagtaaaaagaacaaagctggaggcatcacactaccagaattcaaaatatactacaaagctgtagtaaccaaaacagtaggatactggcatgaaaacagaaacaaaggccaatgaaaacagggaacccaaaaattaatctgcatatctacagccaactgatttttgcaaaaggtgccaagaacatacactggggaaaaggacagtgcctttaataaatgatgctgggaaaactagatatccatatgcagaagaatgaaactagatctccactgctcccctctacaaaagtcaactcaaaattgatcaatgacctaaatataaggtctggaaaaatattttatgaatcagacctcaaagcacaggcaacaaaagccaaaataaacaaatgagattttatcaaactaagcttctgcacaacaaagtagtcagtcaacagagtgaaaagacaacctacggaataggagaaaatatttgcaaactattcatcttagggacagaggcttaatatccagaatatgtaaggaactcaaacatctcaacagcaaaaatcccaaacaattcgattaaaaaatgggcaaatgatctgaacaaacatttctcaaaacacatacaaatggccaacaaatatatgaaaaaatgttcaacatcactagtcattgagaaaacacaaaaacacaaatcaaaaccacaataaggtttcatctcatcccattaggatggctatccccaaaagacaaaaaaaaaaaaaaaaaaaaaaaaaaaagcaaatgctggtgaggatgtggagaaaagggaactcttatacactgttggtgggaatgtaaactagtatagccactacgggaaacatatgaaggttcctcaaataactacaaatacaacttccatatgatccagcatcccactattaggcatttatccaaaggaaaagaaattggtatatcaaagagatacctgcacccccatggttattgcagcactattcacaatagccaagatatggaaccaacctagatgtccaacaatagataaagggataaagcaaatgtggtatatatacataatggaatactatttggccataataaagcatgaaatcctgtcatttgcaacaacatagatggaactggaggacattacgtgaaataagccaggaacagaaagttaaacactgcaagttcctactcatatgtggaagccaaaaataaagttgatctcatagaagtaaaagtagaatagagaatactagaggctgagtagggtagggaaaggaggggaacaggaagagatttgttaaaggagataaaattacaattagacaggaggaataaattctagtgttctacaccattataggatgaccatagctaacaataatatagtttcaaacagctagaaggagaatattgcatgttcgcaacacaaagaaatgataaatgtttgagagaactgatatgctaattatcctgatctgatcactatacactgtctgtatcacaccatcactatgtaccccataaaatatgtgtaaatattatgtgttaatacaaaaaaagaccaaaaaaaccaaatacaagaagtaaacaaagtaagcattaccaataggtgaacaacctgacatatgcctcctaaaatgatgcaatacaaagtaccctgtatcatgtaggttgtattcttgccaaaatgtgaatctaattacaagaaataatcggacaatctaaaatgtaagaaatcctataagacaactggctttgagtctccaaaaaagttggtatcatgaaaaagaattttctacattacaatgttctactttaagacagatcaaagagatgtaacaatcaaaagcaatgtcttttgattgaataaaccttgattgaatccttggtccagaaaatcagcaaaagctcataaatggattaaatggtatttcactattgtttctatgaacatttcttttattattcttatagcttcctgttttcacactcagctattggtatccagttataagatataaagatcaaacgttctgatgactatcggcatggtaactaggacaacatacaagcatctcttgttccccacaccactttgccttttctgatttctgtgaccaccactacccacctaccctgttcagaattctctcaagctcgtagactgcttgtagggccccgacttccagaaccctcagctggcagagtaagaggtgaatcacggcccggggacaagtcagcatgtggcagtttaaacaagagccccgaagcagcaggtacagcttctgaagagagggaataaaaacaaacaggatattagaaagagacacagtagccatggtgattttcggtatactcacaagtttctttatgtagtcagtctattcctttaaaaactctacttcagcctacatgcttagaaaggcctttgttatcttaagaaccagataaatattaccctctattttcttttaaggttttattttaatccatttagatttgaaatttactttgggcgtacaacctgaggtagaaaaatatctttattttattccaagatttaattaagagacttctcagccaggtgcggtggctcatgcccgtaatcccagcattttgggaggccaaggtgggcagatcacttgaggccagttacttgaggccaggagtttgagaccagcctggccaacatgatgaacctgtctcccgtaatttttgtaaaaatacaaaaattagctgggcatggtggtgcgtgcctgtaatcccagctactagggaggctgaggcacaagaatcacttgaatccaggaggcagaggttacagtgagccaagatcgtgccactgcactccagcctgggagacggaatgagacactgtcttaaaaaaaaaaaaaaaagacacttctctttaacacgattaacagacaaaaatcatgtccatgtataccaacatatgtgtagcttaaaaaaaaaaatcctggaggtgaggttagctgaaataaaaagctgaaaatgtaccagcatgactctaaacaggagcttcattctgacctcactgttgggctttctggggctttgcttctcctgccaccacacaagtgcctatagagacacctgaagggctcagggagaccctgagaacactgaagttctctctattaccaggcaggtgccactgagatttctgaagagcacaaagcccctgcaacaaaaggtgtagggaatgaatctgaactctccccgaccctccacgcaaacggaatcaggctgtggctctattcaactggaatcaaactgatattcatttatttagggccacagggtaagttgaagttattgtatttggctcaaaacttcaaaatctcattctacagaatgctttcattggagtgcctggggcttaacctccttagaccactcttgtgggagagaggcagcactcacaaatcccaccagcagcccggagacccacacaactaaggcagcacttacatcgaagaggagagggttatacactgtgagtgggagctcaatgtggcccaggtgcccagaacagttgctgaagtcctgcacgcaggtggagcacacctctttggaatctgcagggcccaaagctaaatcgtacaggccgtttgccgatgggttccccaggctgtccaggtatcgagggttcgtaatggatttaacacttaatttcctaaggggataaaaaagaccaagaggaaagctaaagttaccaacctctctgatgtttcctttccagcacaaacctatagttaagtgattatttaatgcctgcttgatagctctggagggcacaatctgtctttctcactagtgtaccccaacactaagtgcagagttggtacccaatagttaataaatacatatgtgctaaatgaataagtcataaaatacatatgtgctaaatgaatgagtggtaacttcttaaaaacagatttagaacaaaacttgcactaagtacactggtaaactgttcataaaaaggagttaagcatctactatacactgactgcttcacaggcagcattattctgtctttttttttttttttttaacaaggtctcactcctgttgcccaggctagagtgtagtggtgcaacctcgactcactgcagcctcaaactcctgggctccagtgatcctcccacctcagcctcccgagtagctgggaccacagatgtgtgtcaatatgcccaaacaatttttcgattaatatttttttgtagagacaggatttagccatgttacccaggctggtcttgaactcctgagctctagagatccgcctgcctcagcctcccaaagtgctgggattacaggagtaagccaccatgcctggccgcattatttagtcctgatcttaatcctctgaaatactcatcactacatgtacttttcagaggacgaaaccaaggctcagggaagttaggtgattgaatccaggtgacacaaatacaaacagaatgtgggggaggcaggatatggaatagacttaactccaaagcccacccagttcaatgaagggaatgtgatgcaacaatccctgtatgcagaaatagtaaatttgacaacattaaacacatttagtcaaaccttaaaaaaggtttcatcacattttatgtttggtttgaaaggtgctcccataggacacaactatgtttagtaggctaactttgcttttacaattttctcctttctgatttagaaaataaagacaaagaaaccatcccaatctgacagcctagaggaaatccgaaggctgaaacgagagtcccctaatgatgtaaacactccctttaataaagcacaaaaatagtgtcaagttttcatgagtggtgacatgttctgagtgtaaaacaatgttagtctatcaggaactaagctgctcagctctagaagattctatgttgcatggccagtgtcactctaagggccaaggcgacagggaggcagatctgctgctgtggctcttgtctatatggtcaccttgctgccagtaagctaatttcatgagaaacttgatctaactcaaaagttgtgcgtgtggtctcttcccacaaatctagagtccacctgcaaccctgaactgggtaacattgaacaaattacttaccttttgttctttaatcttaatttttgaaactgtaataaaatatatataaattcatcataactgtttcaattagtacagttcagtggtattaagtacatttgcattgtgctaccatcaccactctccatctgcagaaccctttttcatcttgtaaaattgaaaccctgtacccattatacagtaattcttcatctcctctgctaccatcattttactttctgttttgattaatctgactactctaggtaccttatattaagtggaatcacaccgtacttgtccttttgtgactggcttatttcacttagcaccgtgccctcaaggttcatccatgttataggatgtgttgaacttttttccttttttagggctgaacaatatcccattgcatgtatataccacattttatgtatcaacccatccattgatagacacttgggtagtttccactttttcactattgtgaataatgctgctatgaacataggtatacaaatatctctttgagaccctactttcaattccttggatacacatccagaagtagaattgctggatcacatggtaattttgtctttagttttttgagaatccaccctactgttttccatagtggttgcaccattttacattcacactaatggtgtacaaaaagcttccactttctccacacccttgccaacacttactactttctgtttttctgatagtagcaccctactggatttgaggagctttttatttgcatttccctaaaattggtgatgttcaacatcttttcacatactcactggccatctgtatgtcttctttggaaaaatgtctgtttaagtcctttgtccattttaaaattgaattttgtgttgttgttgagttgtaggagttctttttatgttctagatatcaatctctcatcagatatataatttacaaatattttcccccattccatgggttgccctttcactctgctgactgtatcctttgataactacctaatttttttctcacctgaagtctgggcatcacagcagctctattgggatgattagaagataacatacagaaaatacagtgtcaaacaaagttcctctctctttgtagaggagaaagtccctcccaccattacaggagtgggatgaagagtaggggcaactagcaaggattccaccagtcagtagagtttgagatcaatagacttaggtttgaagatgacctttgccacttcctagagagacattttgttctctgggcctgaattttttactggaggtgccaccacaaatggtgttgttaagaactgagaatgggtgtcgttaaggactgaaagtgccaagcactgagcagctagctcctctatccatctattcatacactcaacaaatacccagagtgctcactgtgtgccagacagtgttaagtgctaaggaaacagacaagaactgctatgcttacaggccttacattctattggaggaacgggaacagacacaaaatgtatagtctgttagacggcagaaagggctatgacgaaaaataatgcagggaaagggaagagcagagtaggcaagtggtcctagaagcccactaaggaggaacttgggcaaaggctgaaggagttgagggagcaggccatacagtcacctgggcagagggttttacaggaggaagaagcagggagtgcaaaggtcctgaggtggatgtgtgcccgtggtgctctggatgcagcaaggaggtcagggtagccagaatagaggtgagatcagagaggtaacaggagactgaaatgacccctccaggccatttgtaaagacttggtttttactctgagtgagatgggaagctattagaacctggcacaataaaaggtggcagtattattgaaatgtctcaactctaaacttgtttgaaaactccacaattatctttttaaaaattcaggcaacttaaaacacttctgcttttggatgaaatcgtatccacttatggcagtgatgatataattggaatttctgggctagcacactgttaccaatgataccagagctgtggctcaggagtttattcatccatttattcagacttgaggataaaagacaagagtgacacatataagaagctcaaggatagtggaggaagacaaatatacataagcacaaaaagtcactaaagcaccatgacagacaactgtatcatgtgcaaaatgacctcacaaaacaagggaggtgaactgagctttcaggtgtgtatgttgggtaggggacagagggaagtacctccttttggctgaaaggacactgcatgcagagggaatagcttaaagaaaggcccagatgttgaaatatgatggcggtttctggaatatgcaggtggtttaatagggctgaagaagggatgatgttatagctaaaatcagcattggtctgatcatgggagactttgcaggctatgctaagaaaatatactttatctgagggaaatggagaacatttggagggttttaagggtgacagtagcatgactacatttgcactttgcaagaataattttgacagcagtgtggagcatgcacttgagaggtgtaaggggagggtggaaggaaaagacaattcaaatatgagataagggccagaggcaacacagtagcaattgggagaaaaaggagactaagaacaaatagacatgtaggtgacacaaagtaagagcccaataaataagttatatgtcaggagagatctagaataattttccagtttctagtgactattttgcactacgtacaccattttggaggggtaagtaacccctccctttgaagagggatgccgtgttgagtttttttttttttttttttgagacagagtattgctctgtcgccaggctggagtgcagtggcacaatctcggctcactgcaacctccgcctcctgggttcaagcgattctcctgcctcagcctcccgagtaactgggactacaggtgcccgccaccacgcccagctaatttttgtatttttagtagagacggggtttcaccatgttggccagggatggtctcgatctcccgacctcgtgatccgccggcctcggcctcccaaagtgctgggattacaggcgtgagccaccgtgcccggccatgttgagtttctgatatgcatttaggccatgttgagtttttgatatgcatttaagatctctgtgtgaaattcaattaaagatgtacagacagctgaacaaatgggtctgaaaatcagggaaataaatttgcgttggggatttaaatttgagactataaatcatgaaagtggtgagattgtctagggacaatatttaccatgaagaaaacattactagaatagaatcttgaagaacatcaacatttaaggagtaaaatgaggtacagaccttgctcaccaatgtgtcattaacgcctagcttggtgcctggaaaaaactggatgctcaataaatgtttgtgaggttatagatcgatagaggaagagagggaggtagaagtatttgtcataaaaataggagaacttgaagacaaataaggttctggaagaaaggaaagtttcaagagagtgcattggagaatgtcaaatgctaccttgatcaaaatgaagactaaagagagttcccttgatttaacaaccagaccgagaatatagcagggtcctagcaaagagaagttaacgcctgaactgacacttgaaggacaatcattttacaaacaagaggaaacttactacgtgcctaattaaccatgtcaggtacactatggttaattccacaaatgcttgttagttaacgaggagactggcagatgataacgctgcagaccaggaccctccccacccttatattcccctacctcagcgcaaactctttcccccagcaccaccggcctcttatccaggcagtccacgccggcccaggaacgttcccagaactacggctcccagcaggacaagcgccagacaagcctggactcaagaggatagactgggcaaaagcgcttctgggaatcgtagtttagggcgccgacctcaagatccaggctgggcacgctacccgaccaactccttacttgagctcttcagccgaatacatcccgaaggaaatgccctgcagccgccgccagggcatgttcttggagatcaacatcctccaggtccgttttgaattccgacaccccaagagacgttccactcaccacctgactattcttaattcaacctcaagcccggagtcaccacgcgattcaacgtgcgcttgcgcgcggaagcggtcgcaggaacgacatttacgtggatgagatcacttctacatggggggggaacaaatagttgtacgactctctgctcgctcttttgttttgaaaacaatcaaagatatataagacatcaaaataatcatttaggaaaattcctccgaggcaaatcgggtgtatagagcttttagcttccgtgacgaagtctttcaaaccatgagcttgcaacctcccattttatgattgctttcgtcttcttccgcttcagccaatagcggagctgttccctgctccccgcccactgcgccccaccttcctgaaggtcgaggcacgctttcccaacatgctctgcagagaaatcaaagatggcggttgtatctgctgttcgctggctgggcctccgcagcaggcttggccagccgctgacgggtcggcgggcgggtttgtgtgaacaggcacgcagctgcaggtaagagacgcttagggtatccgcgaagaagaccgcggagtcaccttagtcctatgtttcccagctggctgtggaagtaggcacgatgaaatggtttgctcatgcgcgcccttaacggtcgcgtgcccttaagaccaggtacgcggaggtggccctttgaaataggattcgcaacgcatttattcattagagaaatacttattggttgcttgcaatattctgtagttaacaccatccgcaaagctaggaccctgctctcatgaagcttgcgttccagtgagtgtggctattagcaacactaccccaaattaaaaattatccgccattactcattttaacccaatcaggaggagcgaggagaacgtacaagatcttcccaaataaaaggcagtctctggtcgccaccgtggggactttggctaaagaagttatcaggttttcgtaaaagcagaaaagtctaaaagatctgactatgcccttttgatctgtgatagttatagcttggaacatgtatgacctatctgtgtaatttttttttcactcagtacaaacagtggcattgtgggaatatgagaggcagtaatttgtagtgaaaacttgctaaaagcctaattttaggtttagtgtttgccattcacttaattggatgataatagacagatttcctcatctgcagactagagttggtaataaccatccgaaaagtttgtgaggtataagtggggtatgtaatttacaatatgtttttatatgtactctcccttagttcccctcaagaaagagaaaccactccatctgatactgcagaaacctttgtgctgccattcaatgccagtcctccgtttcctggtagccatcgttagcatttttctactcattttctttgcctgaagcagaatctcttcctcagcatccgttctcaaaataactgtgatctctgttttaaggtcatgagaaacaaatagtgtgacttgaaagagttgatctcagaaacttgaaagagttgatctctttctgaaatgtccttaacgtagaggggtattcttgttttaaatgatacctgaaaccagatactactggaggaagtatctgtctgtgcaatcacatcttgacaattttctgaatgttactgatgccatttagtaaggggaaacacaagataatactaaccgtcacattatctgtggtgtgttgactgtgtttttagtgtgatcagaacacttaaacagaacacttaaaaactcagtcatgggccaatgattctatattttggtttaaaaaggatttcatattgaacctctgaaaatagaaaatatcagcaattccaagtctaaatcaggccttatgtatttggtacattcttgattgttgaaagaagtggaatgagaagccatgggtcatcttccctatgttgtaattgctttaagtgaggtagtcctttctgatcagggcagtatctgtatagaagcaagagctcactgaattgttcttttaaacatcatagtgttttgggttcctgaagttgaaagttcttcatttcaaaccagattgttcaagtgctattaaaaactttcctccctctctgccatttatgtaatgagattgcttgcttccaaaacttttgtctagccgggcatggtggcatatgcctgtagtcctagttactcaggaggctgaagcaggagggtcacttgagcccaggagttcaagggttcagtgagctataattgcactacttcactaaaggctaggcaatggagcaagaccctgtctctaaaaaaaaaaaaaaaaaagttttgacagtcttgtccatatcttgtatccattccttaatgatattgaacatgtgtacagactgtcttctcagcgttcattgacatgagttatccagtttaatccgtgataattggagaatttgggctcaaagtacacataggtggaggtgagctgggtacttcattaatgactattagatttaaggcttttgtttttttgcagattttattctggtagtgcaaccctctcaaaggttgaaggaactgatgtaacaggtatattttaaaatatattgaattctatttttatatcaacacgttggattccattgtagtactaggaaactgattcatgttttcttttttacattagggattgaagaagtagtaattccaaaaaagaaaacttggtaagtattctatcagtgttcattcagcaaatggttgagtgcttactatgagagaagtgtaagggttaggtaaggagacagtgacaggaagagcaataggagagcattcttgaagagagtagctgagcggggagaagctaggagtttaaaggacaaaaaatggaaaggtggagaatagtgagtgaatgagcaatgagatttacttaaaagaacaattgaaagagattttgaattagtgtgggttactatttacgtggttaataatacatggttatacatgaacatcatcattagaataatttttttcaaggaagttctctcatatgattcaagagcagacagttactgtctttattatctctaatgaggtaaaaataaagtaaatggtgtggacagcaaaatttagcttttttattcactggatatatccttgaacaaattgcctcatctcatttattcaacatttgttgaatatgcaggaattaaaacttcacaaaagtgcttgttacagtgtagtcctattgaacgcatttagtggcccctcaaaaagctaggtcttaaaattatgtgacctaaagactcgggttcgccaggcgcggtggcttacgcctgtaatcccagcactttgggaggccgaggcgggcggatgatgaggtcaggagattgagaccatcctggctaacacggtgaaaccccgtctctactaaaaatacaaaaaaattagccggatgtggtggggggtcgcctgtagtcccagctactcgggaggctgaggcaggagaatggcgtgaacccgggagacggagcttgcagtgagccgaggtcgcgccactgcactccagcctgggcgacagagcaagactccatctcaaaaaaaaaaaaagacttgggttcatttaaaaagacttttttaagaactttattaatctgaactgtgtgattattttagggaggccagggagcccagtgatgtcaatgcataggtaactgggatcataaaagaagtgcaaattaaaacttaccgtattggcagagagaggatttgaagaaatacgtttgtttatgggacagtaaattggaacagctctttggagggaaatttggcagaatcagaattggaaatgtgcgtaccttactggttagccactttggaggaacatttgcatatatacatggacaagactgttctttattacttgggaatagtaacaggttgaaacagcctgaatgcccattgaaaagtgaatggataattttaaaaggttatcatacaataactttttacattgaaaggaattaattagctctatatttaataacatggatagtgcagccaaacttatgtagacacatgcagaatgacagtgtgtatacgttttttagggagatgtttatgtgtgaaaatacctttaaaagttctggaaatacaaataccaaattcatcgtggagaggggtcacaagatgacaccagacactttaggttaacgtgtaatgttctagtttatttttttaagataatgtatgataccttttaaagtaaccctttaaagaaagagaattagtgagtaatctgaatgtcatcattttttcactgccatttgttcaatatgttaggaaagtttgctaacttgataagacttaaatagggcaataaaagatctgctgaaggaatgctgacagatgagagaatgtgtcgttatcacacttgctgaaattacataaatgtgacttctaaacgtggatagaaaatttagtggatattatgtacatcagggaattagttttgatgaaatataaaatttcctgtacttttgtttttctcagatgacttatagtcttaagaatgttatgttaaactttatttagaaaaatactcttggtataattcccttttggaaaggaaacacattaaatctaacataggagcacaaatatatttgagatcaaattatcttgtctgtcatttattccagtgaagccttttctaatagttcagtaaaggtctctactcagaggtgcagtggacagctggcctgcaattcttaccataacgttatatatggttgagaggttctaaaccaggaggttgcatcagaattatctgggaattcagtaagagtgtgtgtgacagtcctccatggatcttgggaggctttgatgcaataggtccagagtgaagcctgtggtttattctcctataactgaatcaagagctaccaattaggatagtaaaggcaacagtagtcccgaaagctgcagtaagaatccataggaaagtgggtagaggaagtaggccagatagttttatgagggcgggatggaaatcactagccctgggttatggcattatgcaccaggccagagaggacaggcaaagagaggaacatgtaccaactaggggaaagaaccagcagttttcttaatttctaatttattctagtgaccttgtgacataaccagcttcagatgagatctgcactatgttattggccagtacactgagagtagaatcacttgttcggtttgtggctatgaagagccctgatgaggattaacttgtggttcttatttttagggataaagtagccgttcttcaggcacttgcatccacagtaaacagggtaagtaggattttgtgtttttttttaacctaaaacttggctaataacacactttttaactcggctaataacacatttaatactcatacctcgtcattactcagaattaaactgttgtgcgtctagaaagtttctttaaaattgtctaggccgggcgcggtggctcacgcctgtaatcccagcactttgggaggccgaggcaggtggatcacaaggtcaggagatcgagaccatcctggctaacacagtgaaaccccgtctctactgaaaatataaaaaattagccaggcgtggtggcaggcacctgtaatcccagctacttgggaggctgaggcaggagaatggcgtgaacccaggaggcagagcttgcagtgaggagagatcgcgccactgcactccagcctgggcgaaagagcgagactctgtctcaaaaaaaaaaaaattgtctaatccagctgagccaggtggctcatgaatgtgatcccaacacttttggaggccaaagtaggaagaccacttgacatcaggagttcaaaaccagcttgggcaatgtagcaagacccccatctgttttttgtttgtttgtttgttttgttttgtttgagacagagttttgctcttgttgccttaggctgcagtgcaatggcgcgatctcggctcaccgcaacctccacctcctgggttcaagcaattcttctgcctcagcctcctgagtagctgggattacaggcatgtgccaccacgcccaactaattttgtattttaagtagagacggggtttctccatgttggtcaggctggtctcgaactcctgacctcaggtgatccacttgccttggcctcccaaagtgctgggattacaggtgtgagccactgcgccaaacttttttttttttttttttttaatttattttttgagacggagtcttgctgtgtcgcccaggctgaagtgcagtggcacagtcccggctcactgcaagctctgcctcccaggttcatgccattctcctgtctcagcctcccgagtagctgggactacaggcgcccgccgccacgcctggctatttttttgtatttttagtagagacggggtttcgctgtgctcaccaggatggtctccatctcctgacctcctgatccacccgccttggcctcccaaagtgctgggattacagatgtgagccacagtgcccggccttttttttttttttttaagaataaaattattggccaggagcagtggctcacatctgtaatcccatcactaatcccatcactttgggagaccgagggaggctgattgcttgaggtcaggagttcgataccagcatggtgaacatggtgaaaccctgtctctaccaaaacaacaaaaacaaaaattacgaggcatggtggcacctgtagtcctacctattcaggaggctgaggcaagagaatctcttgaacctgggaggcagaagttgcagtgagccaaggtcctgccactgcattccagcctgggtgagttagtgagactctgtctcaaaaaaaaaaaaaaaaaaaaaaatttaaaataaaattatcaaatccctttatttggcaaaggaggaagctaaggttttgaaagtggccagtggctggttaggatgttaaaaccttaattaaaggcttaatttcacgccttttatctcgaaatgcagtgtttttctaccataccagtgatctttaatccctggaagggcttgttgaaatgtatgttcttaggggacgatttggctgtagtataccaacttggagaaataatgtacctgtcatgctgacaatcatgtaatgattaataatctgggtcctggagcctactggtttgttttaatagccaagcaactagctttatgatcttagggaagttactttacctcttgatacttctgtttcctgacttataaattgggggttaattatagcaccaaacctcaaggttgcagtggaattattaacaaatgaattaagtatacgtaagatttaggatagagtctgggacaaaggaaattcttggtacattgtattttgttactgctactactgtattgttgatttcattgacatgaaattttctctgttggcaactcaagagtagagtttgtagtctggtagatacactgaaactttggtaaatgcatcagaaatggaactttctgcttggttgtattttttattaaccaaaaacttttaatttcgtctgtggggaaaagtctaaaataattaagtctttttttctgccacagtatctgtatggatattgatcctccttaagtcgattattacaagtacgcagaattgttcttctattgtggatattaaactacatctaaaaatggaactactaggctggacatagtggctcatgcctgtaatcccagcagtttgggaggtcaaggcgggtggatcctgtgagctcgggactttgagatcagtctgggcaacatggtgaaaccctgtctctacaaaaaaacacaaaaattagctgagcgtggtagtatgcgcctgtagtcccagctacttgggaggctgaggtgaggctcacttgatcctgggaggtggaggtggaggttgcggtgagccaggatcgcaccactgtactccacagagtgagaccctgtcccccccgccacacacaaaaaaattaaatataaaataaagatggagctactaaagatagtgttgggtctaatgtgcactggtgtactctaccagtttctgaaaaaggactttactacatctccctacttgcaaagcattgagattttcagtagctcacttatccataaataggcacctgaaatgtaaacatagaaatggacctccgagatattctcaacatttcaatgagaatggcccagggccactttcaaatcaaagaagttatagaattgtgtgtagaattgtgacttatctggcccttaaaatccaagagttattcgtttatccattcattcagcaacaatattttgtgcccttatgatgcttatcaagcactgtgctggatatagaattagacacagatattgtgtagttctagaggggaagactgaggtagcactgagaaggggttgtatcgccaagactgagaaaggaattcttttttttctttctttttttttttttaaagagacggagtctccctctgtcacccaggctggagtgcagtggcgcaatctcagctcactgcaagctctgcctcctgggctcacgccattctcctgcctcagcctcctgagtagctgggactacaggcgcccccacccccacgcccggctaatttttgtatttttagtagagacggagtttcactgtgttagccaggatgggggtaaaggaattctaagcagacattttagaaaagagagctatgtggagaatgggaaagctttccacttgagagtgtgataaagagcttagcatatccaaaaccaaaccccattccctccaaacattcctcacatatttctttgccatctcattaatggcaactccattcttatagctgctcaggccaaaatcctgggaattgttagcaaagcctttgtttatcccttcaaaagatacgtgtgtgtgaggtctccgtgaccactcccaggctaagagttatgacagcaagaagatacaaagcaaagtcagcaaagagaaaaggctcattggataaagaccaaaagaaatcagtcacaagcttccaaaagacctctccagaagattcaacacaggacatgcttaattcctccatcagtgacttgtgacaacacatgcaaagtgtctaccaaagctcattagagacccagtgcccagagtttttaggggaggctggccatgtagaccacccactggctggcatatattataccaagtttccatactcccagaagggaagcaggtgtttggcacaaaacacgttgtacaaacaggttaggcacagtgaaccattcttagcagttctaggaatggtgagaacccttccaatatccaggttcccagatggcagccaagggccagccttggacgcagaccttcctaaggataatggtttcaggtctgttaactcttttctgcaaaatatcaaaattttagatgcctgatatcactaccagtcaccttggttattgtcgtcttacaagtctggattaattgcagcagtctctgtcgtctcccactgcacctccctgcacactgctctcagttcagcagctgtagtgaccctggatcatatcactcttaagaattcaacattggctttccattagtataattcaaataaaaactgaagttcacaacagggctgctaaggtgaggctcaagggaaaggggtttttgaaaggggtagcagaaagctaggtccaaaataaaacactgcctccaggttccaggtatgagcagctttccgttgagagctgcagggaagcttctgtgccccctccctgaggagtccaggtcagtaaaacagcattaaggatataggataagtttttgctttggaataaaggcccaagtaaggcactcagacacagaagagaataaagaaagcaattctggggcatttctcagtggggcccctggtggtattggagagttgattatgctcaggtttagggagcaattttaatgggtaacaggacgtgggagaaggttctgttgttcattcctcagagggcacggt

SEQ ID NO: 464 - DNA, 23637 bp, Homo sapiens
gaactcctgacctcaaatgatctacccacctcggcctcccaaagtgctggggttacaggcgtgagccactgcgtctggcctcccccactttctttttttgttttttgagatggactctcgctctgttgcccaggctggagtgcagtggcacgatctcagctcactgcaagctccgcctcccgggttcacgccattctcctgccccagcctcccgagtagctgggactacaggccccccgccaccacacccggctaattttgtttttgtatttttagtagagacggggtttcaccgtgttagccaggatggtctcgatctcctgaccttgtgatctgcctgcctcggcctcccaaagtgctgggattacaggcgtgagccaccgcacccagcccccactttcaaactatgctctggaacaagtcatttccgcctagaatccaccttcatgttttctcgtctatccgctggagattgagaagttttagggaggtttggatgagacatggaccacatatgggcagactttagctgcagagacttagtccaattattctggagcctgagacacagagaggccaggaaggtggcaatgagccatgacccaaatgcagcgtctccacctgcctgaactactcatcgcctctgcctgaactactccactaactatctccaacctcgtgtgcctcttctcctcaacccattcccatagaagcccacatgatcttttaaaattataagttagatcacgtgagtccccttttcaaaacagagaattaagaacacttgaaattcagtctcaaattccttaccatcacttactgttttttgtttgtttgttttgttttgttttgagatggagtctcgctctgtcacccaggctggagtgcagtggcacaatctcggctgactgcaatctctgcctcccgggttcaagcgattctcctggctcagcctcctgagtagctgggactacaggtgcctgccaccatgcaggctaatttaggttttttgtttttttttttttttgagacggagtcttcgctctgtcacccaggctggagtgcagtggcatgatcttggctcgctgcaagctccacctcctgggttcacgccattctcctacctcagcctcccaagtagctgggactgcaggcgaccaccaccacgcccggctaatttttttttttttgtattttttagtagagatgggggttcaccgtgttagccaggatggtctcgatctcctgacctcatgatccgcccaccttggcctcccaaagtgctgagattacaggagtgagccaccacgcccagcctaatttttgtatttttagtagagatggggtttcaccatattggccaggcttgtctcgaactcttgaccttgtgatccacctgcctcgacctcccgaagtgctgggattacaggcgtcagccatcgtgcccagcccatgtactgctttgcagagagttttgagtttgaaggtgcataagaatcaccaggaaggtgtgttaaaacacagattctggggccccatccccagagttcctgatttggcaaatctatgatggtacctcatcatttgcctttctagcaagtccccagatgacgctgatgctgctggtctgggaccacactttgagaaccactgctctgctgctcctcctggcttcttcccctggcctcacttgacaccaaggttttgcctgctgcagaccttttccttttggatgcgatctgcctccaggtcttttttttttttttgacatggagtctcactccatcatccaggctggagtgcaatggcgcaacctcggctcactgcaacctccacctcccagattcaaattttccttgtctcagcctcccaagtagttgggattacaggcacccccaagctggcccggctaatttttgtattttttagtagagccagggtttcgccatgttgaccaggctggtcttgaactcctgacctcaggtgatccgcccgcctcagcctcccaaagcgtttgaattaccggcatgacccactatgctcagccagctcaaatgtcacctcagagataattttccctgaccaaatgtcaaattgaagttctcctctctcagccacgttcaagcacatcatattccgtttttttgtttttgtttttgagacagggtctcactctgtcacccaggctggtgtgcagtgacatgaacacagttcactgcagcctcagcctcctgggcttcagcaatcctcctgccttagcctcccgagtagctgggactataggcgcacaccaccacgctcagctaggttttgtgtgtgtgtgtatttgttgttgagatgaggtttcttcatgttgcccaggctggtctagaattcctaagctcaagcgatcttcccgtcttggcctcccaaaatgctggggttacaccactgaacctggaccctatgttacttcttcatagcccatcctgcgatctgaaatgaccaagtccatttatttatttactaatttattatccacccatgctccacccaatctggaatgtaatataaatacttttgtgttatttgcatggtgtgtgccctgggattgggaacactgtaagtgttcaagaagtagtcaagaaagaatgaatgaatgggccaggcacggtggctcacgcctgtaatcccagcattttagggagccgaggcgggtggatcacttgaggtcgggagtttcagaccgccctggccaacatgataaaaccccatctctactaaaaatacaaatattagctaggcatgatggtgcatgcctgtaagcccagctactcgggaggctgaggcacgagaattgcttgaactggaggccagaggttgcattgagccgagatcataccactgccctccagcctgggcgacagaaagagactctgtcttaaaaataaataaataaacaaacaaacaaacaatgacggactaaggggaggggcagtgatagcaagaaaaagaaagcctatttggggacttgcaaggagagagacagaggacagccggggcacagacttcagtgtccttttccttctcctactgaccccacctgcttatgaagccagcctcggatgtgcacgggaaggttgggatccctcctgagcgcattgcctctcttcccaaaggcgtggatcttgtttactgcccgggtgggcttctgaggagagaaggggacagaagtgaacagggagagcctaggatggtcctgggagggggtgagggtggacacaggcaaccgtaggctctcgcttggctgccctgagaaatgggtcaaggaccagccgggcgcagtggctcacacctgtaatcccagcactttcggaggctgagacgggtggatcacgaggtcaggagatcgagaccatcctggctaacacggtgaaaccccgtctctactaaaaatacaaaaaattagccgggcgtggtggcgggcgcctgtagtcccagctactcgggaggctgaggcaggagaatggcgagaacccgggaggaggagcttgcagtgagccgagatcgcaccactgcactccagcccgggagacagagtgagactccgtctcaaagaaaaaaaaaaaaagaaagaaagaaaagggtcaaggtgggggctgaagttggagatcagaattgggaggtgttcttattgcagagttaagagactcttttttttttgacaggctctttggagtgcagtagcctaaacactgcagcctttacctcctggactcaggtgatcctccagcctcagcctcccatgtagctgggaccacaggcatgtcccaccatgcccagctaatttttttactttttgtaggggacgggggtctcactttgttgcccaggctgggagagactctttttttctttttcttttgagacagagtctcgctctgtcccccaggctggagcacactggcaccatcttggctcactgcaacccctgcctctcgggttcaagtgattctcctgcctcagcctcctgagtagctgagattgcaggcacgtgccaccacgcctggctaatttttgtatttttagcagagacgcggtttcgccatgtcagtcaggctgctcttgaactcctgacctcaggtgatccacccgcctcagcctcttaaagtgctgggattataggcgtgagccactgcgccgggccgagactctttttttgatgggcagagggaggtgttcagaggcaaggaagaggctgtagggaagcaatttggggatcaagcatccactgccaagaagcagatgcccttggccaccagagccagagctgtagtaggtcctttgggatctgaactgggactatgggctgggagggccccataatcagggggaactctcacgctgagtctccagtgaatcaaaggatgccctggtgccctgcggtcacaccccttagcaaccaagtacaaggagaggaagcctcaaatccctccatcctgcccggatggagcctcatctcctgatgcccacagatatctcaggcatccttagccaggtcccgacaatatgcccttccttggaagcggtggtactgaccaaggctgagatcagatctctgggctctgaacttgagaaacaatatgtgtggaacggcaggaggaaaaagaaatgagtgtctccctaagcttttggctgggatgccgatttgggatgcaagtatctggaggccccttgggtcttattgtcagagaagggtctctccttataggatttcattagtgggtagattggatggcgagagataggacagcaagttctggcactaatcaagagcagccactacttctcagaactcgaggggcctcatggctggggagcggctttatcttagcaaccagggtcaagggaggttgttactctggtttagaattaggaaaatacaaagggtggggacagagctgggagtgcctctgaattcctagctgcggtgtgtaggcaatttgggaccttactatgtctggcagaccccgttgctaaggatctttgtccttaacaaccagagtccttggggaaacagaaggatgggcggcccagagccccaccttcctccccatccccgccaggaagctcaaaccttggggctcaggctgctgagcgaggagatggtggaggcgctgctggccaggctcaggctgctgcgaggtcggctcccctccatcaagggctgggggagagaaagaaaggggctgtgtctctgcagtgacgggtgtgagacagagatggggtcaggggcttggaggtcggaggaggctgcagagaaagagcctgttgtttcgggacttggggggctgggggaggccatggcccgtgaccacataccaagagtggtgccaagagaggtaggcggccctggcagctgcgggagggggcagctgtctgcagcccaggccagagaataggggcttctttattcctgcccactgcactcaggccaggaatttgaccctctctgtgcttagggactccccattccctgcctccttccggctgccccaggctacctgtctcccgccctcccacatgcacccccaaaccacccctgccaactccccaagccaagccctgcggcaccaggaatgtgaacccagagagcccctcccagcccagccagggaacttacccagctctggggtcccagtgacgggggggcaagaggacggtgtgggtgctgcggcacctaggcagtctcccgcctcctttgtctcttagctgctgtctctcatagttctcaatctctctcctcacctgctcactcacactttttgtctctttgtctcctgtctcttacggtctctctctctctctcttccttttacactacctctctccccactctcactttctgtgtctccctctgatctctgtctcttccagtctctctctcactcattctctccctctctctctctctccaatctttctgtttctgtccaaatcttttattgtcagactcacagggtctcttccttaagtctctgtctcattctctctctctctctctctctgtctctcagtcatcccctgtgtcctctctccttcacactcagtctcttcctctttctctctggctctgccgtttcctcccttttctctttccgatttcccttctcactttctcccttcctccctctcccagtttctctttcctctctgctggtctttccctgcctctgccagccgcccacgctgctgttctcccctcccaatcccggctgtccccgccccttctggcctccccactacagcctgacctctggctcagctgcccccatagctgaagggaggggcttgggccccccaattcccaggtcccctaaggaccaaggttgggacttctcagtgtttggagagttggacttgaggcctgcactccagggcccccgtgggtttgctgctgtggttgggggcctgagccactggtgtcctaaacggaggaggcttgtgtcctgcaaggggtggggactcaaatttccaaagccctggagggaatgggttagggatccagactcctgggtgcccgagaaggtctgagctaggatcaggactcctgagtcgtgaaagagctgggggtctggaaacatggctgtgcttggaaggggccagggacggtttgtccaggtcccctagggagaaaaggggatggtcccagtagggcagggtgaaatggagagttccaaacctccacctcagatccaggtgagaattctcttctagactgaggacaactccctcaggagagagacatgattccttggtatattttgaggaacaagattatgcatccgtaggcaggggaggagagcggggggctggaactgtcacccagggcctggaacttgtagcagaagcgcccccacccgcacaaagagtgccacccaggcagaatcgcggcttgtgggggcagagctactgcctaagtctgaagcagatgacacccaggagtggagccttgtgcctgtgaccgggaaggaatctgagctttcggtttaactgccattcaccatgcacctgttgagcacctactgtgtgcaggcactgtctgttgcagccactgagaagaaagcagtgagccctggctgggtgcaatggctcacgcctgtaatcccagcactttgggaggccaaggcaggaggatcgcttgagaccaggagttcaacaccagcctgggcatcatagcgagaccttgtctctatttagaaaatgaatttcttttttttttttttttgaggcggtgttttgctctgtcgccaggctggagtgcagtggcgtgatctcggctcactgcaacctccgcctcccgggttcaagcgattctcctgactcagcctcctgagtagctggaactacaggcacatgccactgcacccggcctaaattaattattattattatttttttgagacggagtctcgctctgtcgcccaggctggagtacagtggcacgatctcagctcactgcaagctctgcctcccaggttcacgccattctcctgcctcagcctcccgagtagctgggactacaggtgcccaccaccacgcccggctaatttattttgtatttttagtggaggcggggtttcaccgtgttagccaggatggtcttgatctcctgacctcatgatccacctgcctcagcgtcccaaagtgctaggattacaggcgtgagccaccgcgctcagcctaattacttttttttgaaaagcattgagcccagcaaagtgcctgatctcatagtgcttacatcctcattctcatttgcaaggaatctggaccctgctgtgactatcttggtcaagtggcttcatttccaagcctgtttccccatctgtgaaatgggaacaatgacaccctcgcactcggggaggaaaccaaccacatgtgaaaataggagactctagccaggcgtggtggcaagctcctgtactcccaactactcaggaggctgaggcaggagaattgcttgaacccgggaggcggaggttgcagtgagccaagatcatgccattgcactccagcctgggtgacagagtgagacaccgtctcaaaaaaaaaaaaaaaaaaagaaagaaaaagaaaaaagaaagaaaagaaaaaaaaaagaaaatgggagactctaggctggggcctgtgggctaaattggggtaggaggccaggcacagtggatcacaactgtaattccagcactttgggaagccaaggcgggcagatcacctgaggtcaggagttcaagaccagcctggtcggccgggtgcggtggctcacacctgtaatcccagcactttgggaggccgaggcgggtggatcacaaggtcaggagatcgagaccatcctggttaacacggtgaaaaaccccgtctctactaagaatacaaaaaaaattagccgggcgtggtggtgggcacctgtagtcccagctactagggaggctgaggcaggagaatggcgagaaccagggaggaggagcttgcagtgagccaagatcgtgccactgcactccagcctgggcgacagagcaagactccgtctcaaaaaaaaaaaaaaaaaaaaagacctgcctggtcaacatggcgaaacactgtctctactaaaaatacaaaaattacccaggcattgtggcacatgcctgtaatcccagctactccagaggctcaggcaggagaatcgctggaacccaggaggtggaggttgcagtgaaccgagatggcgccactgaactccagcctgggcgacagagtgagacgcctactcaaaaaataaataggctgggtgcagtagctcacgcctataatcctaacactttgggaagccgaggcaggcagactgcctgagctcaggagttcgagaacagcctgggcaacatggcgaaacactgtctctactaaaaatacaaaaaattagctgagtgtggtagtgcgtgcctgtaatcccagctactcggaggctgaagagggagaatcgcttgaacccggaagatggaggttgcagtgagccgagatcacgccattgcactccagcctcggtgacagagcgagactccatctcaaaaaaaaataaaaaaataaaaaataacaaataaataaataggcctggagtggtggctcacgcctgcaatcccagcactttgggaggccaaggcaggcagaacacctgaggtcaggagttcgagaccagcctagcaaacatggtgaaatcccgtctcagaaaaataaataatgaataaataaataaataaataggccgggcgcggtgactcacgcctgtaatcccagcactttgggaggccaaggcgggaggatcccctgacgtcgggagttccagaccagcctgaccaacatggagaaactacgtctctactaaacaaatacaaaattagccgggcgtggcggcacatgcctgcaatcccagcactttgggaggccaaggcgggaggatcccctgacgtcgggagttccagaccagcctgaccaacatggagaaactacgtctctactaaacaaatacaaaattagccgggcgtggcggcacatgcctgcaatcccagatactcgggatgctgaggcaggagaatcgcttgaaccccgaaggcggaggttgcggtgagccgagatcgcccctttgcattccagcctgagcaacaagagcaaaactccgcctcaaaataactaactaaataaataaataaattggggtgggaaggcattgaccctgagctgagagagaactggctcgctgttgaagcagggccacgcatttgattgacagttcgtttgttggaggggcgtggtcacgctcggaaactccgccgtgacgttgcaaaagctggaatctccgcgagaagtcctgtcttacttccacttcccacccttcgggttgcggtctcgaaaccccgcctctcttcgtgacgtcagcacgccgggcgcggtaggctataaaagcctagtggccattgtgttcgttgctcttatcggttcccatcccagttgttgatcttatgcaagacgctgcacgaccccgcgcccgcttgtcgccacggcacttgaggcagccggagatactctgagttactcggagcccgacgcctgagggtgagatgaacgcgctggcctccctaaccgtccggacctgtgatcgcttctggcagaccgaaccggcgctcctgcccccggggtgacgcgcagctcccagccggtgagtaaggggtcggaacgcctgggtccccacggggctgggggcccggatttagaaaggagaaggggttgggagcctggagtcctgagcctgagggaggagggatctggaagccagattcttgggtcccccgtgaaggaatcatctgccaagtagggggtcgggtcagaatgtttcagtctgcgagggaggagggtgtgagggtttgatttgtcaatcttcagcagaatgagagagctagggactatgactttgtcgccaagggaagcaagtaaagacttttgttcttggttcttgggactgggagttctgcgtctgaagaaagagagggctgggggcttggacccttggatctaaggcagaactaggggctcagactcctggctattgagagataagaacagagccaagggacagagatgggcgtggccgagatcagaaaggaatttgggactctcgcgttgctatttacaatagttgtgttactatttccgttgctatgactcatagtcacgcccggatgccatcctctaaatggcccctaaactttatttttttctcccccttttccagcccagacacatggccccaggccaagcaccccatcaggctaccccgtggagggatgcccaccctttcttcctcctgtccccagtgatgggcctcctcagccgcgcctggagccgcctgaggggcctgggacctctagagccctggctggtggaagcagtaaaaggagcagctctggtagaagctggcctggagggagaagctaggactcctctggcaatcccccataccccttggggcagacgccctgaagaggaggctgaagacagtggaggccctggagaggacagagaaacactggggctgaaaaccagcagttcccttcctgaagcctggggacttttggatgatgatgatggcatgtatggtgagcgagaggcaaccagtgtccctagagggcagggaagtcaatttgcagatggccagcgtgctcccctgtctcccagccttctgataaggacactgcaaggttctgataagaacccaggggaggagaaagccgaggaagagggagttgctgaagaggagggagttaacaagttctcttatccaccatcacaccgggagtgttgtccagccgtggaggaggaggacgatgaagaagctgtaaagaaagaagctcacagaacctctacttctgccttgtctccaggatccaagcccagcacttgggtgtcttgcccaggggaggaagagaatcaagccacggaggataaaagaacagaaagaagtaaaggagccaggaagacctccgtgtccccccgatcttcaggctccgaccccaggtcctgggagtatcgttcaggagaggcgtccgaggagaaggaggaaaaggcacacaaagaaactgggaaaggagaagctgccccagggccgcaatcctcagccccagcccagaggccccagctcaagtcctggtggtgccaacccagtgatgaagaggagggtgaggtcaaggctttgggggcagctgagaaggatggagaagctgagtgtcctccctgcatccccccaccaagtgccttcctgaaggcctgggtgtattggccaggagaggacacagaggaagaggaagatgaggaagaagatgaggacagtgactctggatcagatgaggaagagggagaagctgaggcttcctcttccactcctgctacaggtgtcttcttgaagtcctgggtctatcagccaggagaggacacagaggaggaggaagatgaggacagtgatacaggatcagccgaggatgaaagagaagctgagacttctgcttccacaccccctgcaagtgctttcttgaaggcctgggtgtatcggccaggagaggacacggaggaggaggaagatgaggatgtggatagtgaggataaggaagatgattcagaagcagccttgggagaagctgagtcagacccacatccctcccacccggaccagagggcccacttcaggggctggggatatcgacctggaaaagagacagaggaagaggaagctgctgaggactggggagaagctgagccctgccccttccgagtggccatctatgtacctggagagaagccaccgcctccctgggctcctcctaggctgcccctccgactgcaaaggcggctcaagcgcccagaaacccctactcatgatccggaccctgagactcccctaaaggccagaaaggtaggtgctgagagcccagattctattttttttttttttttaattgagttggagtcttgggctgtcacccaggctggagtgcagcggcatgatcttggctcactgccaacctctgccgcccaagttcaggcgattctcgtgcctcagcctccagagtatctgggattacaggcgcatgacaccacacccagctaattttttttgtatttttagtagagacgggggttttgccatgttggccaggctggtctcaaactcctgacatcacgtgatccacccatctcagcctcccaaagtgctgggattacaggcgtgagctaccacatctggctgagagcccagattcttgagtcttagaaagaaagggggctgggggccgagacttctgggtccctgtatgttgcagagggttgcatgtcatctccatggagaaggctgtgtacgctgtcacgcaatcccttgtaagaggccaggcccctgggggaggagggagcagctgtggctcacagcagccccaggaaaccacctcttccttcagtgagtcagatagatagagaatcccgtgacagtgacaggcaagtgactagccagatagaaagcatttttgtgtaataactaatttttgtttgcttctctctctctcttccccgccctccccatccggattcccgtggctgtgtgcatctcctgcctgtgtccccatgtctgcccgcaggtgcgcttctccgagaaggtcactgtccatttcctggctgtctgggcagggccggcccaggccgcccgccagggcccctgggagcagcttgctcgggatcgcagccgcttcgcacgccgcatcacccaggcccaggaggagctgagcccctgcctcacccctgctgcccgggccagagcctgggcacgcctcaggaacccacctttagcccccatccctgccctcacccagaccttgccttcctcctctgtcccttcgtccccagtccagaccacgcccttgagccaagctgtggccacaccttcccgctcgtctgctgctgcagcggctgccctggacctcagtgggaggcgtggctgagaccaactggtttgcctataatttattaactatttattttttctaagtgtgggtttatataaggaataaagccttttgatttgtagcgagcagcgtctgtatgtgtcagaaactgacagcattctacttacaggtccctgagggagctgggaagagaatagcataaaacaaagcacttcaatggcggataaaccgcttttcctcaaatttgctaccactcatcctgaggcttcttttgaacctaacagtgcagggaccagccccacagggtcggtgggcttctccctgtgtgcggcgacgagagagtgtagaaataaagatacaagacaaagagataaaagaaaagacagctgggcccgggggattactaccaccaatgcgcggagaccagtagtggccccgaatgtctggctgcgctgatatttactggatacaaagcaaaaggggcagggtaaggagtgtgagtcatctccaatgattgataaggtcacacgagtcacgtttccaccggacagggggcccctccctgtttggcagcccaggtggagagagagaggagacagcttatgccattatttctgcatttcagagacttttagtacttttactgattttgctactgctatctagagggcagagccaggtgcacagagtggaacaggaaagtgaaacaggagcgtgaccgctgaagcacagcatcacagggagccggttaggcctccggataactgtgggccagcttgactaatgtcaggccctccacaagaggtagaggagcagagtcttctctaaactcccgcagggaaagggagactccctttcctggtccgctaagtagcgggtgtttttccttgacactgaggctaccgctagaccatggtccacttggcaacgggcgtcttcccagatgctggcgttaccgctagaccaaggagcccttctgctggccctgtccgggcataacagaagcctcgcactcttgtcttgtggtcacttctcactatgtctcctcagctcctatctctgtatggcctggtttttcctaggttatgattatagagcgaggattattataatattgggataaagagtaattgctacaaactaatgattaatgatattcatatataatcatatctaagatctatatctggtataattattcttgttttatattttattatactggaacagctcatgtcctcggtctcttgcctcggcacctgggtgtcttgccgcccacataacagctggtgggttttatagttttttttgttgctttttttgagactgagtctcgctctgttgcccaggctgaagtgcagtggtgcaatctcagctcaccacaacctctgcctcccaggttcaagtgattctcctgcttcagcctcccgagtagctgggactagaggtgtgcgccaccacgcctggctaatttttgtatttttagtagagacagggtttcactatgttggccaggctggtctcaaactcctgaccttgtgatccacctgccttggcctcccaaaatgctgagataacaggcgtgagccaatgcacccggcctatgtatttttgtttgtttgtttgagatggagtctcgctgtgtcacccaggctggaatgcggtggcacgatctctgcttactgcaacctccgcctcctgggttcaagcgattctcctgtcttagtctcctgagtagctgggattacaggcacactccaccatgcctggctaatttttgtatttttagtagagacggggtttcactacgttgatcaggctggtctcgaactcctgacctcatgatccacccgccttggcctcccaaagtgctgggattacaggcgtgagccaccgcacccagacccggcctgtagtttttctttgacatctgcctaaattgtattaaacttgggacaattatcaccacccccccaagggagctggagaattgagtcacggatccctaaaaggaggcagaattgtctgtgccttgctggaccattaaggctcaatctctacaggcctttacattctcctccgttgctttgataccagtgggtatcgaggtccccaagcccgggtgggacctccccctcagccagtgttcaggctcttgacacagtcatgaaaatgaattcaaggacgagttggaaaagagtgaaaatacaggatttattgcaaaggggaaagtccacactcatgaaaggggactcgagagaatcacgtgcaaggggggttgaggctgctaccgttatgggttttttgtttgtttgtttgttttttaaagatggagtcttgttctgtccagcccaggctggagtgtagtgacacgatctcagctcactgcaacctccacctcctgggttcaaacaattctcctaccttagcttcccaagcagctgggactgcaggcgccaccacacctggctaattttttgtatttttagtagagacagggtttctccatgttggccaggctggtctcaaagtcctgacctcaagtgatccacctgcctcagcctctcaaagtgctgggattacagacgtgagccaccacgctggccctttttggatttttttaaccaaggggtaaaatactcatgagcattcctggaaaaagatggagatttctcagaactgtggtgccacccatctttacaccaaatatgggtgttcctgggaccgtcatgatgctggtgggtgtgtgactgtgttgatgaacatataatgaggtcctacgtgaaaccgaggtcagacccagtgccatattgggtctagtcggacttagcctacttggcccacgccctggtttttcaggatcttatcagcccatagcttctgtagctatttcaagtttcctgttgctggtctggtcttgtgaaactgctgcctggaattttctaatctcctgcaaccaccctgtatgattgctgttgcagcctgattttacatttataagccctgtgtccataggcctagtttccttatctgtaagctgactaacaattgtacatatcttatgggattgtaaggccccaaaggagttaaaacaatgctcatgaaataaatgctataatacggtaattattctatataccgttattcttttttttttttttttttttttcctgatacggagtctcactctgctgcccaggctggggtgcagtggtgggctctcggctcactgcaacctccacttcccaggttaaaacaattctcctggatcagcctcccaagaagctgggactacaggtgtgcgccaccacttccagctaattttttttttttttatggagtttcactcttgttacacaggctggagtgcaatggcacgatctcagcacaccagcaacctccgcctcctgggttcaagcgattctcctgcctcagcctcctgagcagttgggattacaggcgtgagccatcacgcccagctaagttttgtatttttagtagagaaggagtttcaccatgttggtggtcaggagtttgagactcctgacctcatgatccgcccacctcagtctcccaaaatgctgggattatgggcatgagccactatgcccacctctacctctaatttttaatttttttttttttttttgagaccgagtctctctgtgtcacccaggctggagtgcagtggcgtgatctcggctcactacaaccccctgggttcaagcaattctcctgcctcggcctccctagtacctgggattatatgcgtgcgctaccacgcagggctaatttttgtattaatctacctctagaccttcacagaatgcaggctcctctcatcctcctaacctaatggcctttcattagctttacaaaagcagcttagttaaactagaaatcctagcactttgggtggccgaggtagatggatcacttgaggtcaggtttttgtttgtttgtttgttttgtttgtttattttgaggcagagtcttgctctgtcgcccaggctggagtgcaatggcaggatcttggctccctgcaacctccgcctcccgagttcaagtgattctcctgcctcagtctcctgaatagttgggattataggggcccgccaccacacagggctaatttttgtatttttagtagagacggggtttcaccttgttggtcaggctgatctctaactcgaggtcaggagtttgagacccccactcctgccatataatcctttcatttccccaaggcaaccaagcctaattccacctaattaaaaacctttgtatgagtgctacctgctgcctgaggatcccaaccctgaggcctcttgctcagctagttgctcctgattcttcagatgtagtgtgaaaattcctttttttggtggggggatagagtcgcattctgttgcccaggctggagtgcagtggcacgatcgggtcactgcaacctccgcttcccagattcaagcaattctcgtgcctcggccaccggagtagctgggattacaggcatgcgccaccatgcccagctaatttttgtatttttagtagagacggggtttgccatatcggcgaggctggtctcgaactcctgacctcaagtgatccttccgcctcgacctcctaaagtgttgggattccaggtgtgagccaccgcgcccggcattttttttttttttttttttttgagacagagtctagctggagtgaagtggagctatctcagctcactgcagcctccgcctcccagattcaagtgtttcttctgcctcagtctcctgaatagctgggattacaggtgcctgccaccacgcccagctaatttttgtacttttagtagagacggggtttcacatgttggccaggctggtctcgatctcctgacttcaggtgatgcaccagcttcagcctgccaaagtgttgggattacaggcgtgagccaccttgcccggtcagtgttggttattaaggtggtgcaaaagaaggcatgtcggggcccttcctccaaatgaggaggcacagaagctggcaagggtatggtattttattgagttattcaacagccagcttctaattgaaactggacaagcagatgctgaaggcctggagcgggctaaatggaaagcagaagtccatggtgaatgtgtctgggcccactcggccgaactggagcaccagatgttcttctgagaagtgaatcaggaacaaagccttagcctgactctctcatctcccagcttcgagaactgagactttttttttttttttttcttttttttttttttttgagacagagtcttgctctgtcgcccaggctggagtgcagtgacctgatcttggctcactgcaacctccacctcccaggttcaagcagttcttctgcctcagcctcccaagtagctaggattacaggcatgtgccaccacgtccggctaatttttttttttttttttttttttgagatggagtctcgctctgttgcccaggctggagagcagtggcgcgatctcggctcactgcaagctccgcctcccgggttcacaccattctcctgcctcagcctcctgattagctgggactacaggtgaccaccactacacccagctaattttttctgtgtttttagtagagacggggtttcaccgtgttagtcaggatggtctcaatctcctgacctcgtatccgcccgcctcggcctcccaaagtgctgggattacaggtgtgagccacagtgcccggcctaatttttgtatttttagtagagacagggtttcaccatgttggccaggctgttcttgaactcctgacctcagatgatccacccacctcggtctcccaaagtgctaggattataagcgggagctaccgcgccaggccgagaatggagacttttaagaggctgagcggtgcccttactaagccagaaaccctgagggtgtgtaaactacaattcccaataggctttgcaatagggtggcatctgccctgcctagaaaaacgctcaagtgatgatgggagatgtagttcccttccgttcacaccctaacccccaccccacctggcccggctaaactggtttccaggagctcacggtgtttgggatccacgatttggaagttcttcaccgaagcccgagtgactcgaccatggaaattgagcgtgtagacaccgttctccttgtcccacgacggggttttgttgtgcaacaaaagcaacccttgtttgtccccacgttggtaacgactcagtagcgactcctgttcctagaaggtaaagaaggggctgtggttttctcagaggctttcgaaactccatcttgaacaggggcgactccatcttgaacaggggcgactccatcttgaacaggggctgggtaaaatgaggatgagacctgctgggctgcgttcccaggaggttaggcattcttagtcacaggatgagacaggagtttgacaggactggtatcacaatgttagaaatgcttgttccccggtgcagtaaagaaatagcacttgagcataaatttaatttcctcagcaaggccattttttaactttctgcagaaagggtacactcaccaggagttttgccatgagagtacactgaacaaaggagacagggtcatttataacctggcgcatccaccctactgccgtgtagggtttccattggctggaacgggacctcacgttctgtatttgtcccaattggctagcaacttagaactttttaaaagagggaaaagcagaagaatacaaagtaaggaggaagtaacttgtggaatgttgagaaaggtaaaaacaccttcaaataaggaagaggaacaggctatgacctaatgcttgcttggaccggtacaagcatgccagggcaaatatttagggtaaattgtgggagctaaaaacgtaaagtacactgatttctttattatggctaacagatatttaagaatgttagcacaggtctttgaataaattttgcttgtaagagaggttactgccgggcacggtggctcacgcctgtaatcccagcactttgggaggccgaggcgggtgaatcacgaggtcaggagatcgagaccatcctgactaacacagtgaaaccccggctctactaaaaatataaaaaattagacgggcatggtagcgggcgcctgtagtcccagctactcaggaggctgaggcaggagaatggcgtgagccggggaggtcgagcttgcagtgagccgagatcgcgccactgcactccagcctgggcgacagagcaagactctgtctcaaaaaaaaaaaaaaagaaagaaagagagagtctaaaagaagcaggaaccctcagttctgggaattgcccacccctttcccagaaaattaatgaataatccacctcgtttagcatataatcaagaaataaccataaaaatagccaaccagctggcctcaaggctgctttgcctatggagtagccattcttttatttcttctctaataaacttgctttcacttgactctacggactggccccaaattctttcttgcctgagatccaagaaccctctcttggagtctggatcagacccctttttggtaagtttgttaacctaccatcaaaccttttttctccagatgcaaatgttttgagtctctagtcttttactccctgagacatggaaggctaacaaagtccttcaggcttcatgtgacacctgcaacccactggcctcctcttcctcctcttcttcttcctcctctgggatctaggaggaccggccccagccccttctccattgacccagagattcctgatgtcagggactcacatttagtggctggacattgattcgctggttctggctgttggttcctgggagaatcacagtcattttccgaggccccaggtatcctaagacgttgggctcctgggggtattacattccagttggcctggttccttcttctgactatcctaccccattctctcatccccaggacactcacataacacacagcccccagctcctgtctgatccgggcagtattcctggttaaatgctcccggtcaggattcaccccattgtcaaagatggtgaacttggtgctgaagacattggatctgctccaggaagggaatggatagaataaaaatactaagtgttactctttgagtaagtgtcactcatcgcatcgactcttcccatcaatcccctatgtctaagactatgtccgaatgtctaagaatcatgttcctggctgggcacaggggctcacacctgtaatcccagcacttcaggaggcagaggcaggaggatagcttgagcctgggcaaaatggcaaaactccttctctacaaaaaatagaaaaattagttgggcgtggcagtttgtgtctatggtcccagctctcaagaggctgaggtgggaggatcacctgagccccagaggtcaagcctccaatgagccgtgatcttgccactgcactccagcctgggtgacagaatgaaaccctgtctctaaataaatatataaataaataaaaataaataattaaataaatgaggccgggtacggtggctcacacctgtaatcccagcactttgggaggccaaggcgggtggatcatctgtggttgggagttcaagaccagcctgacagacatggagaaaccccgtctctactaaaaatacaaaattagccaggcgtggtggtgcatgcctgtaatcccagctactcaggaggctgaggcaggagaattgcttgaacctgggaggcggaggttgtagtgagccgagattacgccatcgcactccagcctgggcaacaaaagtgaaactctgtctcaataataataataataattaaataaatgaaacaaccatgtttccagcatccatggtcccaggccccctcatttcttgggtgagccatgtactttatgtagcctccctattttatttaaagggccctttaggaaccctcttttttttttttttttttttttttttctgttgcccaagctggagtgcagtggctcaatcttagcttaccaagacctctgcctcctgggatcaagtgattctcctgcatcagcctcccaagtagctgggattacaggttcacgccactatgcctggctaatttttgtatttttggtagagacggggtttcaccatgttggccaggctggtctcaagctcctgacctcaagtgatcctcccgcctctgcctcccaaagtgctgagattataggcgtgagccacctcgccactccctctacctttttggatgcaataattcacacattccaggcctcttttcccacagaaagttaggaatcccagtcccttgcctgtcaaggagtcaaatgccttaaatgccagcctacgttccaaacccttcagttcttctggtccctgagcaggtggaaggtatgctctgtggcctgctgggaaatggagtccccctgtccctaagctccctgctacctgctcctcaccacatgtcagagctctacccacctgactttgcccacgaaattgtccccgtcccgagataggtgtgtaggatccagggagatgaggtaattagaagttttgctccttcttctctttcgcccagccaggaggaagcgctatggatgagaggaacagtccattagaatggacttctggatgctgggtgtggtggctcatgcctgtaatccctgcactttgggaggctgcggcgggcagatcacttgaggacaggagttcgagaccagcctggccaacatggtgaaaccccgtctctactaaaaataaaaaaaattagccaggcgtggtagtgcgtgcctatagtcccagctagtagggaggctaaggcaggagaattgcttgaacccagggggcagaggttgcagtgagctgagatcgcaccactgcactccagcctgggcaatagactgagactccatctcaaaacaaaaataaaaaataatgaaagaaaaatggacttctggaagctggttagagccaggggtccaaagacaaggaaacgtcatgtcccatgatagaggagccagtgatggcacaacaagcttctcaagacttactgggaggccgggcacagtggctcatgcctgtaatccca

SEQ ID NO: 465 - DNA, 25394 bp, Homo sapiens
ctactcgggaggctgaggcaggagaattgcttgtacccaggaggtggaggttgcagtgagccgagattgtgccactgcactctagcctgggtgatagagtgagactctatctcaaaaaaaaaaaaaaatctccctgggacagagcacctgggggaaggggtggcttggaaacagcttcagcagacttaaacgtccctgcctgatggctccgaagagaactcccaggacaacattcgagctctgataagggtcagactgcctcctcaagtgggtccctgacccctatgtatcctgactgggagacacctcccataggggccaacagacacctcatacagaagagctctcgctggcatctggtgggtgcctctctgggacaaagcttctagaggaaggaacaggcagcaatctttgctgttctgcggcctccagtggtgatacccaggcaaacagggtctggagtggacctccagcaaactccagaagacctgcagcagaggggcctgactgttagaaggaaaactaacaaatacaaaggaatagcatcaacatcaacaaaaaggacgtccactcagagaccccatctgaaggtcaccaacatcagagaccaaaggtagataaatccatgaagatggggagaaaccagcacaaaaaggctgaaaattccaaaaaccagaatgcctcttctcctccaaaggatcacaattccttgccagcaagggaacaaaactggaaacagagaatgagtttgaagaattgacagaagtagacttcagaaggtgggtaataacaaactcctccgagctaaaggagcatgttctaacccaatgcaaggaagctaagaaccttgaaaaaaggttagatgaattgctgactagaataaccgtttagagaagaacataaatgacctgatggagctgaaaaacacagcacgagaacttcgtgaagcatacacaagtatcaatagccgaattatcaagcagaagaaaggataacagagattgaagatcagcttaatgaaataaagcgagaagacaagattagagaaaaaagaatgaaaagaaacaaagcctccaagaaatatgggactatgtgaaaagaccaaatctacatttggttggtgtacctgaaagtgacagggagaatggaaccaagttggaaaacactcttcaggatattatctaggagaacttccccaacctagcaagacaggccaacaatcaaattcaggaaatacagagaacaccacaaaatcaatgtgcaaaaatcacaagcattcctatacaccaataacagacagagccaaatcatgagtgaactcccattcacaattgctacaaagagaataaaatacctaggaatacaacttacaatggatatgaagacctcttcaaggagaactacaaaccactgctcaaggaaataagaggtcacaaataaatggaaaaacaatccatgcttatgtataggaagaatcaatatcgtgaaaatggccatactgcccaaagtaatttatagattcaatgctattcccatcaagctaccattgacttccttcacagaactggaaaaaactactttaaatttaatatggaacaaaaaagagcccccgtatccaagacaatcctaagcaaaaagaacaaagctggaggcatcacgctacctgacttcaaactatagtacaaggctacagtatacaaaacagcatgatataccaaaacagatatatagaccaatggaacagaacaaagccctcagaagtaacaccacacatctacaaccatctgatctttgacaaatctgacaaaaacaagcaatggggaaaggattccctgtttaataaatggtgttggaaaaactagctagctatatgcagaaaactgaaactggaccccttccttacaccttatacaaaaattaactccagatggattaaagacttaaacataagacctaaaaccataaaaaccctagaagaaaacctaggcaataccattcaggacataggcatgggcaaagatttcatgactaaaacaccaaaagcaatggcaacaaaagccaaaattggcaaatgggacctaattaaactaaagagcttctgcacagcaaaagaaactatcatcagagtgaacaggcaacctacagaatgggagaaaatttttgcaatctatccacctgacaaagggctaatatccagaatctacaaagaacttaaacaaatttacaagaaaaaaaacaactccatcaaaaagtgagcaaaggatatgaacagacacttctcaaaagaagacatttatgtggccaaaaaacatatgaaaaacagctcatcatcactggtcattagagaaatgcaaatcgaaaccacaatgagatactatctcatgccagttagaatgatgatcattaaaaagtcaggaaacaacagatgctggagaggatgtggagaaataggaatgcttttacactgttggtgggagagtaaattagttcaaacattgtggaagacagtgtggtgattcctcaaggatctagaaccagaaataccatttgacccagcaatcccattactgggtataaggattataaatcattctactataaagaatacatgcagaggtatgtttactgtggcactattcacaacagcaaagacttagaaccaacccaaatgcccatcagtgatagactggataaagaaaatgtggcacatatataccatggaatactatgcagccataaaaaaggatgagttcatgtcctttgcagggacatggatgaggctgaaaaccatcattctcagcaaactaacacaaaaacagaaaaccaaacactgcatgttatcactcataagtgggaggtgaacaatgagaacacatggacacagggaggggaatatcacataccagggcctgtcagggggtagggggctaggggagggatagcattaggagaaatacctaatgtagatgacgggttgatgggtacagcaaaccaccatgacaagtgtatacctgcgtaacaaacctgcacattctgcacatgtaccccaaacttaaagtataataaaaattaaaaaaagaaatctaaacacagaaaaggtacagtaaaaatatggtatagtcgattttaaaaggtacacctgtagagtgtgtacttcatgcatggagcttgaaggacttggtgttgctctgagtgggtcagtgagtgagtggtgagcaaatgtgatggcctacgacattactgtacactactgtagaatttatcaatactgttcacttaggctgcactaagtttatgcaaaaatatttttctttcttcagtaataaattaaccttagcttactgtaaaaaaaaaaaaagtgaaaagttaatatttatgtgttctgtgttcaggaaaccaggaggaatggatttggctgaaactggaatacatggatagataaggctagagagataggcaggagccaagccaacaatactaggctcccatcaattgctggggcaggcaagagcaggcatcatcctgagtgtttggagcttcttttcatgttccctaagttggggggtgttggggggatgatacagggggaaattctgattaagacttaacatctattcctttgccttctcttcaagaagtcatacttgatgtccatccctcctggacagggtccgttctgtttgctgctaagctcctttcttatctctcccacctactgaacacgtactgtgttctgggagttttgaatgcatcatcttgtttatcctcatgagatggtctaataatgaagaaagcatgttttggcatccaactcacctgggtatgagtcccagctctgccttttactagctggatgtctttgagcagctcagttccctgttctgtgcttctgtgtcctcatctgtaaaatgggaacgacggctatttcttcagactgccctccctccctccttttctgtctccctccctccctcccttcctccctccctctttcccccttcttcttttcttttctttctctctttctttcttttcttctttccttctttcttttttctttctccttctttccttccttccctcctctctctctctctttatttctgtctgcctgtctttcaacagggtcttgctatattacccaggctggtctcaaactcctggactcaagcaatcctcccagcttggccccccaaagtgctaggattacaggcctgagcacctggcctggactttcttcagacttttcacagggtactagtgagaaaaaaatacatggactctgcttacttaatactgtgcctggcacattgtaagctcttcgcacatgttattgttattattcctcatcctaagggggaagtgcctttgaagggtccacactcctttgttacccaaattgggccaggttgcttaaactgccgttcttcagtagctaacaacaggggtgggagagcctggtcctctgaagtccagctgggcacacggccagtccctggcctgtccctgctcctgctgccctggcaaggcctccctcacccactggggctgcaccagcactggccccagctcagcttcctgtctcccttatcttcctccagcatgtgctctctggagtaggaaacaccaccgcttgcttccttcatttccctttgctcaacgggaccctcattctttaggtctcagtcaaatcccagctgctggcctggtgcccactctgtgattttctacacctcagccacccaggccagatgcagtgtaggccatggctccaacagcagcatttctcttttcttccccacccccatccctgggtttagaatgagaaaaggctcaagttgcccccctcccaacttccctacccgcaacactctttttattttctctgttcccagctccatacttccatgcttttttttttttttttttttttttttgagatggagtcttgttctgttgcccaggctggagtgcagtggcaggatctcggcttactgcaacctccacctcccgggttcaagtaagtctcccacctcaacctcctgagtagctgggattacaggcacgccaccatgcccagctaatttttgtatttttagtagagacggggttttaccatgttgcccaggctggtctcaaactcctgacctcaggtgatccatccaccttggcctcccagagtgctgggattacaggcatgcccagtcccatactttctgagttcaaatcctcgctctgcacttccaagctgtgtgaccttgggcaagttacttaactatttttctgggctttgattttttttttttttttttgtacagaggagcagaggaggattcatcaggttgcccaggttggtccaaactcctgggctcaagggatccttctgcctgggcctcccaaaatgctgggattacaggcatgagccaccatgcccagtttttttggttgttgtttgttttgttttgttttgtttgagacagggtctctttctgtcacccaggctggggtgcagaggcacagacatagctcactgcagccttgaccttttgacatcctgggctcaagccatactcctgcctcagcctcccaagtagatgggaccacaggtgtgtactaccatgcctggctaatttaaaaaaaatttttttgtagagatggagtctcatatgttgccatgctggtcactaatttacaggcatgagccactacacccaggcagctttattttatttatttttttgtctgtagcatggaaacaatgagcatggtctgccccagagaaagtgattaaaggcctagcacatagtatgaatttaaagaatgttttataacatatatattaaacattcaagcatgttggaggtatgtgttaaaaaaatgtattgatggaaagtgatcaaaataatttttgagtcactgtgtgggagttaaattcacaaactttggcaccagagagagagagaaactttcaaattatagcttttgctgtgtgaccttaggtaagtcacttaacctctctgagcctcagtttcttagtaaaatggtgatgctagtgaaacccatttcacagggctagcataagaataaagtaagattatttaagtaaagagccgaacactgtttctggcctacaataagtgttacctataataatgctatcattgtctcactgttcaattttcagggctctagtatatgagaggggtgcttgggaaatagctgttgctgctgctatctgtccatgatggatcttaacctgattagaaaggcctccatgtggctgggcgtgggggctcgtgcctgtaatcccagcactttgggaggccaaggcagatggatcacttgaggtcaggaattcgagaccagcctggccaacatgatgaaaccctatctctactaaaaatgcaaaaattagccaggcatggtggcacctgcctgtaatcccagctacttgggaggctgaggcaggagaattgcttgaatccaggaggtggaggttgcagtgagcagagatcataccattgcactccagtctgggcaacagagcgagactccatctcaaaaaaaaaaaaaaaaaaagaaagaaagaaaaggaaagaaagcccttgatgtaatgagctctgtgtaagataatgtggatgaaagtggacccagaccctacccgcttagatggaaggctcacagcattcaattccaaattggttcaatcgtacactcttttgccctctcttatccatcccaaagtacccttcaagccttcaagggagaaaaaaggcaaagcaaaaatatgcacaacctcactaagaaccagaaaaatgcaaactaaaaccaaagagaaatgccattttacacccaaccatctgataatgccaagggctggcaaggatgtgaagcgagggaattctcatacactgctgggaacgtaaattggcacaacctttctgtaaaacagtttggcaatatctagtaaaactgaagatgcatatactttattactcagaaattccactgtcaagtttgcacctacaaaaactcccacatatgcacaaggactcgagtatgagaatgttcataccagcactgtttgtaatagcaaaaaactggaaaaaacttaagtgttcagcaacaagagaatggatacataaataatgatctattcccaaaattgatttttttttttgagacagggtcttgctctgttgcccaggctagagtgcagtggcatgatcatggctcactgcagtctcaacctcctgggctcaagcaatcctcctacctcagcctcctgagtagctgagaccacaggcacaacccatcacacccagctaattttattttttttgtagagatgggggtctcactatgttgcccaggctggtcttgaactcctgggctcaaatgatccacccacctcggcctcccaaagtgctgggataatacctccccagccggaatattttaaagcagtgaaaatgaatggtctacacatagccacatgaatgaatcttattaatacattaagtgaaaaaagcaaaaggtacagaggaatacatacattttaataccatttatataaagctcaaaatatgtgaaataccactatctattgtttagggatatatacataagtagtgtaagtatacagaaatataaggaaatgaaaaatatcaaatcttcattttcatctgaagtggttacttcaggggctgtggcagggagagagagatgcagctgaggaagagtccatagggggcttcaactatattagcaatattgtatttcttatgcttggtggtggggataggtatgtttgaaatgtaatcctttaagcatgaaataactcttcaaaaatgaaatatttcaggctgtgcacagtggctcaggcttgtaatcccagcatgttgggaggctgaagtgggcggatcacctgaggtcaggagtttgagaccaacctggccaacatggtgaaatcccatctctactaaaaatacaaaaattagccaggtgtggtggcaggtgactgtaatcccagctacttgggaggctgaggcaggagaatcgcttgaatctgggaggtggaggttgcagtgagccgagatcacgccactgcattacagcaagactccatctcaaaaaaaagaaaaaaaaaaagaaaaaagaaatgtttcataatttttaataaaaggcaagacaatataaattggtagttatttaagtcattctacttttcctgaggcccagtgcaggaaaacaaagttcctatccttgttccaactagaccattttgataagctgcaaaaagaaaagactttgatgctatttcttagccagtttgcaacagctgagaggtgagcatggaagctcttgcatatattcagttcagagaatgggtgcttagtttatgtccagagtttgtcccagatttcactatgacgtcagctctccggggagaagtatataaaataaaaagttaaaatccctctcagtcctttacccaatcctattccccagaggtaatctctattgacagtacccctccagatattttccctatgtatatacaaatacacagatacacactgaaagttaattttggccaggtgcagtggctcctgcctataccagaggattgcttgagtgcaggagttcaagaccagcctgggcaacatagcgagaccacatctctagtaaaaataaaaaaaaatagctaggcgtggtggcacagtggcacgtacctttagtctcagctactcgggtggttgaggtgggagaatcacttgagcccgggaggtcaagcctacaattagctgtgattgcttcactgcactatagcctgggcaacagagctagaccctgtctcaaaaaaataataataaattttatatatatatatgaggatgaaattacatatgtattatttgaacagaagtgaaatcttttctttttttttttcagacagaatcttgccgcatgacccaggctagaatgcagtggtgtgatctcggccctctgcaacctccacctcccaggttcaagcgattctcatgcctcggtctcccaagtagctgggattacaggcatgcaccaccatgcccagctaatttttgtatttttcgtagagacgttcgccatattggccaggctggtctcaaactcctggcctcaagtgatctgcccacctcggcctcccaaagtgccagcagcatgctcggaggagtgactttaaagcttttctacttgcttcctagagtaagggacgcattttacactgctatccaaaactcatcatagaaacatacacacacaaaaccaaagcacacatatacaactgagcaaatatttcatgacataacactttctcttactaagggtgacgcgctgaaattttgtattctgtcctatttcattttttaaaaatggtaaccatgacctgctaaattgatttcattgtccactaataaattatgacctcagtttcaaaaagattgctttaggtaaccaatcatcttctgagatttatacagattgctcataattctctcctattttttaaaaacatgctgcagtgaactgctttacactcattttatgactacttctgagaccaagatcccggattatgtaattgttatttacttaaaattctggtaaaatgtagccattatactggaaaactaaattttaatcttggatctgtcaccaccatgatatataaactttgggcaagtccctgcacctctctggacctcaatctccccatcagcaacctgctgatcctactcccaggagtgtgctctaagttgaaagtagatgccccaccccctgagtcagcgccggcaggacttctcaccaagcccttctcccccttttccgctccctgttcctggttcctaggaagcagcccaaggagaagggaaaaggcaggtctgggcaggagggagcaatgaagggcggggcagagggagggcaggagggaggccggccccctagtaggaaatgagacacagtagaaataacactttataagcctcttcctcctcccatctcctggcctccttccatcctcctctgcccagactccgcccctcccagacggtcctcacttctcttttccctagactgcagccagcggagcccgcagccggcccgagccaggaacccaggtccggagcctcaacttcaggatgttgacaacattgctgccgatactgctgctgtctggctgggccttttgtagccaagacgcctcagatggtgagtcgggggcacatctcctgcctcaggatggttctggagaatctcagtctatctgggcacatggcaagaccacaggagagcttatctcacagcatctgtgtctgcagctggctagatctctctacagggcaggcagagtcttggggactggttcgtgtcccaaagccaaggtgagttagtacatttaagcccctgaaaagggggagatgaaagaggctaggggaaacaggatgactggaaacatgagaaagaaaccagcagagagggtaggagaatcagccccagggagaggggagaaaggggaactgagggtgatggtagataggggtacatctaggggagacgggaagaggctcagaagagaagagaaatggagggaatgggaagaccctgggaaaactgatggaagaagtgggggaagagtggggcagagagaggttaggggaggctagggaaaatggaaggagactggtcgcagctggtggaactggggagaaagagatgctgtgcctaatagaacttatgggcgatcaggctactgaagtggccctgtttaagcagaaaagggagttattaccctccattataattgcacaggggcctcctttcccctctctcacaatccccgtaacttcagtctccccctcagagaggcagcaaataataaccagtattcaatgagtgctcactatggttaatacatgtattgacccatttaacttgcacaaacccctaaaggtgggtaatattattactatctccattttatgaggaggaaactgggtcacagagtagttaaggaccatgtctagggttatccataaatatacttattcacatctgcagatacaaagcacaacttctcaaatgcaaacacagacaggacccactcacacacacagatttacaaccccggactcatccaaatgtgctctgggcatcaactctgtgccagcctcttttctgggtgtaggaagcagagattaccaagcatggttccatagcctagaggagtccagtgtggcctgtgtgtgtttggagacagccaggtagtatcccgtgagatacacactaatatatggtggtctgggatcactgaaacagacacactgtgtctcgtggggcatcagaaaaaaatttccaagaagagggcaactgagctgggtctttttttctttgcttttctttcttttttcttttttttttttttttttttttttgagatggagtcttgtgctgtcacccaggctggaatgcagtggcacaatttcagctaactgtaacctccaactcccaggttcaggcgattctcctgcctcagcctcctgagtagctgggactacaggcatgtaccaccacgcctggctaatatttgtatttttagtacagatggggtttcgccatgttggccaggctggtcttgaatccctgacctcaagtgatccgcccgcctcggcctcccaaagtactgggattacaggcatgagccaccgcgcccagtctctgagctgggtcttaaatcatgaataaacttcgccaggcagaaaaagggaggcagagcaatcctgacatgctattcatgtgtcagccaaaggcagcatgaggaatcccaactagtttgatatataagcagcgggaagcggccagaaaaggcagcaggggccaggtctctagcagccttgaatgccaggctaaagactctggacttgatcctgtggggaggcagtgtagcagaatggctgagtgctggacttgactgcctacgtgcaaaccttggctctgctacactatctctgtctcagtttcccatgtagactggggttaataatagtagctattgcattaagccactggggaaaggcacaaagataataatgtatgtaaagcccattgcccaggttataataagcactgaatcgacattggctatgattatttttgattaatgaaggggagggggttatggcactggaagattttaagtaggaaaaggacatgatctcatccctgggtcaggtggaggtcggaatagagaacggggagatgaagtagaaagttactaccccagtctagatgagacggatgaatcctgaatcagggcagtggaagaggagatggagaacaggcgatggaattggaattttattcaggtcaggatttgttaaccatttgttccgttggttaacaggaaacggggggagggagagccgagggtgaaaaaggaggcagaaaggagtgtctcttccactgcaggcctcagtttcctcatctgtaaaacggagataataatccctgtcctgtcctcctggcagagttactgtcagcgtcaaacgggagaagcggtgggagggcacattatagtttatgaagggtcgagaaggcgggcggccagcctcgaggtagggggttattatcttccgctgcccgccgccccctcccacgccggcccaggctgaagctgactctgcccgcaggcctccaaagacttcatatgctccagatctcctacttccgcgacccctatcacgtgtggtaccagggcaacgcgtcgctggggggacacctaacgcacgtgctggaaggcccagacaccaacaccacgatcattcagctgcagcccttgcaggagcccgagagctgggcgcgcacgcagagtggcctgcagtcctacctgctccagttccacggcctcgtgcgcctggtgcaccaggagcggaccttggcctgtgagtaggcgcgcagcgggggcggggtctgggcggggctagtgggggcggggcctggcgggtgggggcggggcctggcggatggaggcgggctgggacttgcagggacccggcagccactggagctcggtggcgcctgggcctttgaagattgctgggtgggggctggagagaggcagttgtccccgctaagaaagccccgactcgggcggtcgtcctgctggcataacctcttgggatagaccctgttggaaggccctgacaccgtgacgtcgaaggtccccagaaaactcctcacccctcgcctcacagtcctccaactccttttcttcatagatctccgtccttcccttcccacagcccccagcacttcaccccccaccctccagccacttctcatacaagctgatgacttcgctcttagctccactcatgacccgaactcttcccccaaagaccccaagttcttctctcaaagccccactccttccccgtcacaaccctaactccttcttctcaaagaccccaatttcttttctcaaagcaccaagcaccactccgtcccccttcccccaccatcatggcctttaactcctttctctcctagtcccccaccccaccccccttttttttttttttttttttttttgagacggagtcttgctctgtcgtccaggctggagtgcagtggcgcgatctcggctcactgcaacttccgcctcccgggttcaagcgattctcctgcctcagcctcccaagcagctgggactacaggcacccgccaccacgcccggctaattttttgtatttttagtagagacggggtttcgccatgttggccaggctggtctcgaactcctgacctcaggcgatccacaagcctggcctcccaaagtgctgggattacaggcgtgagctgccgcccctgccccagcctcaccccctgttttttttttctattacagttgaacaaggcctgacaattcccttttttcatcacagtccctggccccttctttcttagcctctaacaggctaaccccaaacccctcctcacagccccaggcccttctccccatagttccctgacctagactcccctctcctcacagcactgactcttgccttctcatgttcttttccccttggtgggcctcgccccacacctggcaccctctctgcacagtcccctgaccctgactgtctatccacagttcctctgaccatccgctgcttcctgggctgtgagctgcctcccgagggctctagagcccatgtcttcttcgaagtggctgtgaatgggagctcctttgtgagtttccggccggagagagccttgtggcaggcagacacccaggtcacctccggagtggtcaccttcaccctgcagcagctcaatgcctacaaccgcactcggtatgaactgcgggaattcctggaggacacctgtgtgcagtatgtgcagaaacatatttccgcggaaaacacgaaaggtatgatgggacggggcccaggcctgcaagctggggagagggcgggttccagacaaatggatggacctgaaggatggatgcctagagcaacaagaggcccacagctgggggtttgggacagaacacacgcagcttcagtcagttggtaaacgggtccctttcctctggggcagaaacgctttggggtttgactcaaatcatggactccttgggggcctattcttcgggctaactctttgcatgttctgcagggagccaaacaagccgctcctacacttcgctggtcctgggcgtcctggtgggcagtttcatcattgctggtgtggctgtaggcatcttcctgtgcacaggtggacggcgatgttaattactctccagccccctcagaaggggctggattgatggaggctggcaagggaaagtttcagctcactgtgaagccagactccccaactgaaacaccagaaggtttggagtgacagctcctttcttctcccacatctgcccactgaagatttgagggaggggagatggagaggagaggtggacaaagtacttggtttgctaagaacctaagaacgtgtatgctttgctgaattagtctgataagtgaatgtttatctatctttgtggaaaacagataatggagttggggcaggaagcctatggcccatcctccaaagacagacagaatcacctgaggcgttcaaaagatataaccaaataaacaagtcatccacaatcaaaatacaacattcaatacttccaggtgtgtcagacttgggatgggacgctgatataatagggtagaaagaagtaacacgaagaagtggtggaaatgtaaaatccaagtcatatggcagtgatcaattattaatcaattaataatattaataaatttcttatatttaaggcattgttatctcctccactttgcaaaatttctggaaaagtaacctatacccatttcttctgcttccttatttctcactcattctttttttttttttttttttttttgagacagagtcttgctctgttgcctaggctggagtgcaatggtgtgatctcagctcactgcaacctctgcctcccggttcaagcaattctcctgcctcagcctcccaagcagctgggattacagatgcatgccaccacacccagctaatttttgtatttttagtagagatggggtttcaccacgttggccatcctgacctcgtgatccgcctacctcggcctccccaagtgctgggattagacgtgagccactgcgcctggtcttctcactcattcttagacccagtgcaatctgacttctctataaactactctgagatcaccagtaacctctaattgtcaaaccatcaccctacatggtatctgcaaatttgcggactagaactctctttttgccttaacttctgagataccatacttcaatttttaaaactgttctgtctactttttttcaatccctttgactatgtcatcttacacgattcaccctggaaatgctggcttccttagaattccattttttggttccttttgttcctgtttgaactataccctttctaggtgacctactgaccttcatggctgcaaatactatctacctgtggtttccatggagaagcaatataattttatctttaagagcatgtgttttgtcggccaggcgcggtggctcacgcctgtaatcccagcactttgggaggccgaggcgagaggatcacttgaggtcaggagttcaagacaagcctggccaacacagtgaaaccctatctctactaaaaatacaaaaattagctaagtttggtggcacgcgcctgtaatcccagctacttgggaggctgaggcaggagaatcacttgaacccgggaggcagagtttgcagtgagctgagatcacaccactgcactccagcctgggcaacagagtgagattctttttttttttaattctaaaaaaaaaaaaaaaaaaaaaagagtatgtgttttgtcatcagacttaagttttacttctttgaactagaaatttaacttcttcaagtctcagttttttttttttttttttttttttttgagacgaagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccattttagccgggatggtctcgatctcctgacctcgtgatccgcccacctcggcctcccaaagtgctgggattacaggcgtgagccaccgcgcccggcctaagtctcagttttttttgttcccaaatggtattaataaaatataccaaagggtctaagaaaaacaatacccaattcataaaggcatgaagagtattaaataaaagtatatatgtaaaataatatgccaagcgcaagctgggcacggtggctcatgcctgtaatcccagcactttgggaggccgaggcgggcggatcacaaggtcaggagatcgagaccatcctgactaacacagtgaaaccctgtctctactaaacaaaaacaaaaaattagccgggcatggttgcgggcgcctgtagtcccagctcctcgggaggctgaggcaggagaatggcatgaatccgggaggcagagcttgcagtgagccgagatcacgccactgcactccagccttggcgacagagtgagactccatctcaaaaaaaaaaaaaaaaaaaaaaatgccaaacgcaatgactggctcacacctgtaatcccaacactttgggaggcagaggcaggaggattgcttgagctcaggggtttgagaccagcctagacaacatagtgagaccctgtctctacaaaaaaaaatagaaaaaattagctgggcatggtggtgtgggcctgtagttccagttactcaagaggctgaggtaagaggattgcttgagcccagaaggttgaggctgcactgagccatgatcgtgccaccacactgcagcctggcaacagaccaagaaaaaaaaaaaaagatagtgtatgtatagtcagtaaatacagcagtggcttctgatctccagacctctcatttgcattgattctttaaaatcatctctaccttaatgttctgtagacatttcaaaatcaacatgttcaaaatcaaatttattatctatctccccaaatctgctctctctacttctgatgtttactgttcattaatggataacagaataaccatcaaatcatgtaagtggagagaactcagtgttaacctttatttactccctcttatttatccccatctaccaactacagtatctataaaacacattcactcctttctaccccattgcttttgttcaagatatcataattcctctctttctttgtggtaaacatgaaggtgtaccatccagttctacctccaaagaaagacttcctgttggccgggcatgatggttcacgcttgtaatcgcagcactttgggaggccgaggtggggggatcacctgaggtcaggagttggagaccagcctggccaacatggcgaaaccctgtctctactaaaaatacaaaaattagccgggcgcggtgatgcacgcttgtaatcccagctactagcaggggctgaggcaggagaatctcttgaacccaagaggcagaggttgcaatgagctgagatctcgccactgcactccagcctgggcaacaagagcaaaattccatctcaaataaataaataaatacataaataagaaaaaaaagacttgccgttcagctatagggggaatagccagcagatagcttccgcttgcttcagttctttcaatgtctgcctcagctgtagaggacagtcctgcacaagatcatgcccatcccagggctgccctcactcggtgcctaagcaaggcaggggtataaaagttcggtcattttggccaactgcaggacaactctgagaataggttggattgacaagggctagccagggctggaaatattcactccagagctccctgccagggaggctgggtctttgtcagatctgcattgccgtttgacttctctcttagctcagccctacttcttccccctggtaagcatcttgcacctcaaactctgtctcagcctctgcttccagataacccaacttgtgtgtgtgtgtctctctctctttcaaaattgagaaattttctcaatcttgtctggaccatggcagcagcctcctcctaagaaattgcctctaatttctccatattttaattcatcttctacatggcagtaagaaacacagatctaattgtgtcattattccgttttttgttgttgtttgttttttgttttttgttttgttttgttttgttttgagacagagtctctctctgtcacccaggctggagtgcagtagtgtgaacttagctcactgcaacctctgcctcacaggttcaagcaattctcctgcctcaacctcccgagtagctgggattacaggcatgtgccaccacgcccggctaattttttgtatttttagtagagtcggggtttcaccatgttggtcaggctggtcttgagctcctgacctcaagtgatctacccgccttggcctcacaaagtgctgggattacaggcgtgagccaccacgcctggactgttttttaaatttctcattgagttaaattcagaatcctcaaaatgacattcaaggccttgcacaatgtggccccaacctaattttctaatttaattttaatttaattttattttattttattttgagatggagtctcactctgtcacccaggctggagtaaagtggtgcgatctctgctcactgcaacctccacctcctgggttcaagctattctcctacctcagcctcccaagtagctgggattgcaggcatgtgccaccacgcccggctaatttttgtatttttagtagtgacggggtttcaccatgttggtcaggctggtcttgaactcctgacctcatgatctgctctccttggcctcccaaagtgctgggattgccggcgtgagccactgtgcccggcccctcaaattttattttctaccatttctctttagccactgtgccttagattatttattttaaaagcatatttttaaatgacggaagtggtacaacaacagcaataacagagaagtttacaaagaaatttcataaaggaaaaacggaacgcctcctgctttctcattctccccaaatccttactccagaggtatgctaagattattagttgcaagcaacagaaaccaattctgccaacttaaggggaaaataagtatattggaaggttattaagtaatcctcagagttgatgggaaagccagataatcaagctcagaaagtagaaccagggaccacagccaaagtcacaccacaggaatggtattaaggatgccacagctggaagcactacctccatcaccaatgctgctgccatattaaaggaattctcctctgaccctgtgtctttacatcatttgttcaagagtcaatatcctgagtggaagcagccaaatgaccaagccttgatcatgttgcttttgccttagctgcaagtgcaggggggaaaaggaaaactttagatacctttgacttctcttgtgggaggtgagaacctgtctcccattaagactcacacagaggaagagatttcagatgctgggcaaccaaaacaggtacaggtgattttaaagaattgatgcaaatgagaagcctggagatcagtagccactgctgtatttactaactctacatatattatcttttttttgagacagactcttggtctgttgcccaggctggaattggtggcacgatcatggctcactgcagcttcaacctcctgggctcaaaaaacagaacaaaagaaaaataaaatagaaaagcaaaaacaacaaaaacccataaatgttcactatatctcacatcattaatttatttactcgtttaataaatgtttgtcagaaacttccatatagaaggctttatgttatgtactttggaagacacaaaacgattaggatatgatccttctcaaggagcccagtcttttcttgggaagataaaacatacaaaagagaacaacacaaggcaagatgcattgtataactagaagaaacacacaaataaaaatgtgatgttatgtggccgggcatggtggctcacgcctgtaatcccagcactttgggaggctgaggtgggcagttcacctgaggtcaggtgttcgagaccagcctggccaacatggtgaaaccgtctctactaaatatacaaaaattagccaggcatggtggcacgtgcctgtagttccagctactcaggaggctaaggaaggagagtagcttgcacccaggaggcagatgttgcagtgagttgagatcgtgccactgcactccagcctgggcgacagagcgagactccgtctcaaaaaaaaaaaaaaaaaaaaaaaaaaggaaagaaagaaagaaaaatgttatgctctgatttactcttgtagctatcatttacatattgctatatagtttttggaattctgtaacttgcgtttatcatttaatactctctttggtcttgtaagatagatataatcattttagattaggagacatgtttagggagaataagaaagttaataactgatatggtttggatgttttgtccctccaaatctcatgttggaacgtgacctccattgttagagatgggcataatgggaggtgtttgggtcatgggggcagatccctcatgaatggcttaacaccatcctttagtgttgagtgagttcttgttcagttagattacacatgagatctcgttgtttaaaaggatctgagacctcccctcctctttcttgcttccttctgtctcatcttatatgcctgctccccctttgccttccaacatgattgaaagcttcctgaggcctcaccagaagaagatgctggtgccatgcttcctgtacatcctgcagaagtgtgagtcaaaaataaacctcttttcttttataaattagccacttgcaggtattccagtatagcagcacaagaattgactaatatagtatcagagctaggattcaaacccgtgcctttgtgttctaggatttatgctttctctcctctactaaaactgcaggaatcagaggaatctaggggagaaacatggtatttgtgaattggtgagatatgaccatgcccagataggaaagatagacagaacagattcaataatgaaaataggaaaaagcagagtaaattttagacatttcttaaagaagatacaccagtggccaataagcacatgaaaagatgcccaacatcgttatagtcattatggaaatgcaaatcaaaaccatgagataccacttcataccatcaagaatggctataggaggatggatagaatcaatattgtgaaaatgaccatactgccaaaagcaatctacaaattcacgcagtccccatcaaaataccaccatcattcttcacagagttagaaaaaacaattctaaaattcatatggaatcaaaaaagagcccacatggccaaagcaagagtaagcaaaaagaacaaatctggaggcatcacactacctgatttcaaattatactataaggccatagtcaccaaaacagcatgatactggtataaaaataggcacatagaccaatggaacagaatagagaacccagaaataaacccaaatacttatagccaactgatctttgacaaagcaaacaaaaacataaaagtggggaaaggacacccttttcaacaaatggtgctgggataattggttagccacaggtagaagaacgaaactggatcctcatcttttaccttatacaaaaatcaactcaagatggattgaggagctgggcgtggtggctcacgcctgtaatcctagcactttgggaggccgaggcgggcagatcacgaggtcaggagattgagaccatcctggctaacacggtgaaacccatctctactaaaaatacaaaaaattagctgggcgtggtggcgggcgcctgtagtcccagccactcagaaggctgaggcaggagaatggcgtgaacccaggaggtggagcttgcagtgagctgagatgacgccactgcactccagcctgggtgacagagcgagactgtgagactctgtcacaaaaaagaaaaaaacacaagatggattaaggacctaaacccaagacctgaaactgtaaaatttctagaagataacattggaaaaacccttctagacattggcttagccaaagatttcaagacaaaaaaaccaaaagcagttgcaatataaataaaggtaaatagctgggacctaattaaaccaaagagcttttgcacggcaaaaggaacagtcagcagagtaaacagacaactcacagagtgggagaaaatcttcacaatctatacatctgacaaaggactaatatccagaatctacaatgaactcaaacgaatcagtaagacaaaaaaaaaaaaaaaaaaaatcaatcccaacaaaaagtgggctaaggagatgaatagacaattctcaaaagaagatatacaaatagccaacaaacatgaaaaaatgctcaacattactaatgatcaggaaaatgcaaatcaaaaccacaaagcgataccaccgtactcccataagaatggccataatcaaataataaaataatagtagacgttgacgtggatgcagcaatcagggaacacttctacactgctggtgggaatgtaaactagtacagctgctatggaaaacagcgtggagattccttaaaaaactaaaagtagagctaccatttgatccagcaatcccactactgggtatctaccccgaggaaaagaagtcattattcaaaaaagatacttgcacacgcaagtttatagcagcacaattcaccattgcaaaatcgtggaacaaacccaaatgcccatcaatcaatgaatggataaagaaactctggtatatatatatgatggagtactactcagccataaaaggaatgaattaacagcatttgcaatgacctggaggagattagagactattattctaagtgaagtaactcaggaatggaaaaccaaacatcatatgttctcactgatatgtgggagctaagcgatgaggatgcaaaggtataagaatgatacaatggactttggggacttggggcaaagagtgggaggggggtgagggataaaagactacaaatatggtgcattgtgtactgcttgggtgacgggtgccacaaatctccaccaaacaacttactcatgtaaccaaatgccacctgtacctcgataacttatggaaaaataaaattttaaaaagaatggctataggaaaaaagacagacaataacaagtgttggcaagaatgtgaagaaattggaaccctcatacattgctggtggcaatggtatagcactttggaaaacaatttgacagttcttcaaaaagttaaacatagagttattgtgtggcccagcaagtccgctcctagtatatgcccaagaaaattgaaacatacatccatgcaaatacttgtacatgaatgttcacagaagcattattcctaatagccaaaaatggtaataatccaaatgtctgttaattgatggagaaacaaaatgtagtattttaatacaatggaatattatctagccatgaaaatgaggtactgacacatgttacaacacggatgagccttaaaaacatgataagtagtccgggagcagtggctctcgcctgcagtcacaacactttgggaggccaaggcgggtggatcatgagatcgggagttcaagaccagcctgaccaacatggagaaaccccgcctcttctaaaaatagaaaattagccgggcatggtagcacatgcctgtaatcccagctactcgggaggctgaggcgggagaatcacttaagcccaggaggctgaggttgcggtgagccaagatcgcgccattgcactccagcctgggcaacaagagtgaaactccatctcaaaaaaaaaaaaaaaaaaaatgataagtaaaagaagccagtcacaaagaaccaggtattatatgattcaacacacgtgaaacatccagaataggcaatctgaccaggcacagtggctcatgcctgtaatcccagcaatttgggaggccaaggcaggtggatcacaaggtcaggagatcgagaccatccttgctaacatggtgaaaccctgtctctactaaaaaaaaaagtacaaaaaagagctgggcatggtggcacgtgcctataatcccagttactcgagaggctaaggcaggagaatggcgtgaacctgggaggcggaggttgcagtgagtggagattgcgccactgcactccagcctgggcaacaaagcaagactctgtctcaaaaaaaaaaaagaaaaaaaaatagcaatagctgtttaagtcagtggcctgcaaaacatgttaacaattaggtcaattccttctttgcgcttcctcaatccatagtttgatctatcttcctccaaatctgctctgtcactcaggctggagtgcagtggtgtgatcccagttcactgcagtctccatctcgcaggctcaaacgatcctcccacctcagcttcctgagtagctgggactacaggcatgcacctccaagcctgcctaaatttgttttgtttgtttgtttgtttgttttgtagagtcagggtttcaccatgttgcccaggctcgaattcctgaactgaagtgatccacctacctgggcctgccaaagtgctgggattacaggcatgagccaccacacctggcctga

SEQ ID NO: 466 - DNA, 29847 bp, Homo sapiens
ctgacccaatgctcttccattaaaccaggctgcctccccttgatggggctcagaggcccctgccctgtgggcagccatctaagctcatgcactgccacagatatgcatgcagaaggcagggagagaaaataaggaaaattgaataaacagacagaggcaatggtatttcccatccaggtaaatctagagcctctccttgagtcagccagggcaccagaggccaagaggttatttcagcagggggtagcaaggccaggtatcaacctctaggtctagagataggttccaaacatccctaagctcatttataattcgtcagacatctttcatcggttatttaagatatttctcggccaggcgcagtggctcatgcctataatcccagaactttggaaggtcaaggcaggcagatcacttgcaaccaggagtttgagaccagcctgggcaacatagcaaaaccccatctctactaaaaatacaaaaaattagctaggcaaggtggtgcacacctgtagtctcagctacgtgagaggctgaggtgggaggatcaatttagcctggaaggtcaaggctgcagtgtgccgagatcgtgccactgcactccagactgagcaatgggagtgagaccctgtctcaacagatatagctagaaagatgatagatagatagagataaatagatagatagacagacacggccaggtgtggtgactcatgcctgtaatcctagcactttgggaggccaaggcaagcggataacatgaagtcaggagttcgagaccaggctggccaacatggtaaaaccccatctcaactaaaaatacagaaattaggtggcatggtggctcacgcctgtaatcccagcactttgggaggctgaggcaggtggatcatctgatgtcaggagttcgagaccatcctggccagcatggtgaaactctgtctctactaaaaacacaaaattatccaggcgtggtggcgggcacctctaatcctagctactcgggaggctgaggcaggagaatcacttgaacctggtaggcagagtttgaggtgagccgagatggcgccactgcactccagcctgggtgacaaagcgagaatccctctcaaaaacaaaacaaaaaaagaatcccttgatggcaacttgaaggagcccctcatctcctccaggcacaggcacatgtgactaaggacaggaccgggatgtcattgtaaaggttgccgagattcagtgctaagtaaatgcttagccctccaagtctcttatgctaaagtaagggcattgctgggaaaggtctgggagcctgagatgagatggagacatttaggcagacatgaataagactgagaactttgaaaccccaaattcccttgaaattctcatgtctgtagagataagctcctctaatactgctccctcctcccaaaacatcagcctcagaaccctccctgcccccatccctcttgggccccaggcccttcatgagttaggtcccagcacagcccatggagaagcacaaggtcacgctgagagggggacgccgggctgagttacaggcctggccagcttgtcttggcagaagctgcaggagcatgtgtgggagtgtgtgctgagggagctagaccaaggtggggggatggaagccttggtttgtccaaactcgttgccgtggatccttatccaggatttgggatttactgtgttggcctgagcacctgggaggagaattaatagttggctagattggctaattaaagtctggattaagtagtagcctacagttaataagcatgaaatgccagaacttccctggcattctgtagaagaaggaatcagaagtccccgggagacgggaatgctggactggatctatgatgcgcaccttcttagccactgctgccacatattttaggagggtctggaaaacactccctttatgaaagcattaagaaatgcgttcgtgagggccaccagcatccttgacttgctctgatgactgtcctgtcttgactagagagctagtggggtgtgctggatggatcagtggaactggattccctgatctcaatgagaataatagcatcttggtggtacaaaggccaaatggtgatgcttacttaacaaaggcaaggtggatataatagcccacaacaaggcaaagggactaaatcatcaccaggtggacaagatgacagtcctgtggacgatggtcagctgctttcccagctgcccccagggcttgtgcaaagatataaagtggccatggtgacagggatggaagctatgtctgggctcagtaacagagtcttctcctctctgaggctgatctggctgtggccagtgctgagcgtcgacctcctcacagcctagtgctgagtccctgattgggcatcattctcacctcattgtagattggtttgactgggtcctcccatcacgaaggggctgtattttatcttcatgaggataggcacatatttcatgtatgaatttgctgtctctacctacagtgcttccatcagcaccaccactcatggacttactgaatgccatatccatcagcatggcattcaacataatatagcctccaaccagggcaatacatgttacagccaaggaaatgtacaaatgagctcacactcaatgaattcactggccttaccatgtaccccatggaccagaagcagctggctggatagaatggtagattggcctctattagagcacagctgggacactacctctggcagggtagggtgctaccctacaggatgcagggtgttttgttttttgtttttgagatggagtcttgctctgtcgcccaggctggagtgcagtggcgctatctcagctcaatgtgacctccgcctcccggattcaagcgattctcctgcctcagcctcccgagtagctgggactacaggcaccccgccaccacgcccagctaattatttatatattttttttgtatttttagtagagacagggtttcaccatattggccaggctggtctcgaactcctgactttgtgatctgcccacctcggcctcccaaagtgctgggattacaggtgtgagccaccatgaccggccgatgcagtatattttttaaatcaaaaccacagtcatatataccaccaagagggaggggtggcagaggcctcctcactattacatctaacgtctataaccactagaagaatttttttgtagagagaggtcttgctatgttgcccaagctggtctggaagtcttgagttcaaccaatccttcacctcccacctttttttttttttttttgagacggagtctctctctgtcgcccaggctggagtgcagtggcgcgatctcggctcactgcaagcttcgcctcccgggttcacgccattctcctgcctcagcctcctgagtagctgggactacaggcgcccgccaccgtgcccagctaattttttttggatttttagtagagacagggtttcaccatggtcccgatctcctgaccttgtgatccgcccgcctcggcctcccaaagtgctgggattacaggtgtgagccaccgcacccgcctcacctcccaccttaacctcccaaagtccaaagtgctgggattacaggcattagccactgcgtcaagcctcaagtataaattttttggggggggacagagtctcgttctgtcgcccaggctggagtgcagtggtgtgagctcggcttactgcaacctccgcctcgtggggtcaagcgattctcctgcctcagcctcctgagtagctgggtaggtgtgtgccaccacgcccggctaattttttatatttttagtagaaatggcgtttcaccgttttagccaggatggtctcgatctcctgaccttgtgatcagcccacctcccaaagtgctaggattacagacgtaagccaccgcgcccggcccccaagtataaacttctaaagcacttgttctgattcccacccactctacaagaaagagcccctcccccaggaccccgccctctaactctgcacttatgcttgggtgtgtgggcgtgtgtgtgtgtgtgtgtgtgtgcgtgcgtgtagtgtgttgcttaggcacagtatctgttaacactccaggtcccctacctgtctcttccctcttgactgctgagagcatctctttttgtctgattatccccagccccaattcctggcataaagcagagaccaataggtcgggcctggtgcctaacacctgtaatcccagcactttgggaggtcgaggtgggcggatcacgtggtcaggagttcgagaccagcctgaccaacatggtgaaaccctgtctctactaaaaatacaaaaattagccgggtgtggtggtgggcgcctgtaatcccagctactcaggagcctgaggcaggagaatcgcttgaacccgggaggtggaggttgcagtgagccgagattgtgccactgcactccagcctgggtgacagaccgagactctgtctcaaaaaaaaaaaaaaaaaaaaaaaaaaggcagagaccaataaatggttctgaatgaaagaatgaatgaacattttaggcttgtatactatttcatcgtgcatatccaccatattttatttagctatttccttatcattgaacatttaggtgattttttttgttataaataacactgtagcttttcatttgataaattaaataggtgtgcccctgtcagcattcctgaaggggactttttttttttttttttttttttttgagacagagtttcgctcttgttgcccaggctggagtgcaatgcgtgatctcggctcactgcaacctccacctcctgggttcaagcgattctcctgcctcagcctcccaagtagctgggactactggcgcgtgccaccacactcggctaattttgtatttttagtagagacggggtttctccatgttggccaggctggtctcgaactcctaacctcaggtgatccgcccgccttggcctcccaaagtgctgggattacaggcgtaagccaccacgcccggcctactttttcttaattttatttttcacatcctacgtggctcgtctcagctttccatgggccctcggttttccaccggtacataagaaaaaatggaggggaggtatcaattagcgtgagcacctgccatgccccaggcacgcagatgggcgcccctatttcatttctctgccccggcagccttgtgaatgagctttggaagagacagccctgtaaacacatccctctgctgaactgccgcctccagctggctccaccactggcctgctagggtatcttcgccgtttcaacttagtttttctgggcccgtttccttagccggtaacacctggtgggatggttgtgaggattaaattagatatctgggaacgagtcctggccagcgaatgataggttcgcccaagtccagttaaaaggccgtccgcccagggcaaggcgtcttcagggccagcaagactatggggtccgagggagactcggggatctcagcaagaggagaccaatgtgaggagcaggcaaggaacgcttccaggctgcggtggccagggacgcctgagccccgcgggagccggagcggacaggcggaagggtcagctactgcagatagaggcggctggctcgggggcgggggtggagggggtcttcctccttccggttcttgggaagatcctgcaatctgaaagaggcaggagagctctttccccatctgtaatgtggtaaccgagcccgagccagctcctccctgggctggagggtgggagagtcgttagggacacctgccccgctccctccccctcccgggggggaacccaccgcgacggcgcgcacctgggcgcgggctgtgcctgggaacgcgcggggaccgcggcctccaggcagccctgggaaagcaagggccgggagcgcagccctggaggcagagtgttccctcaggaccgtcaggagagcgccatccacaggattattaaaatagccatccagacggaaatcgagtgaggctggcaccagactaaagaagtttcaaggccaggcgcggtgcctcacgcctgtaatcccagcactttgggaggccgaggcgggcggatcacctgaggtcgggggttcaagaccagcctgaccaacatggagaaaccccatctctactaaaaatacgaaattagctgggcatggtggcggtgactgtaatcccagctacttgggaggctgaggcaggagaatctcttgaacccgggaggcggaggttgtggtgagccaagatcgtgccattgcactctagcctgggcaacaagagcgaaactccgtctcaaaaaaaaaaaaaaaaaaaaaagaaagaaagaaggaaagtctcaaagagatatctgtgttcataatggatatcattatgaactcctggcctcaagcagtcctccctcctcggcctcccaaagtgctgggattacaggcatcatcaagtaaactctttaaatgatatttggtgcttcagcctcttcctttgaggtcaataccactttagctatcattaagtcatgttcgtgatagctaaaatgtggaagcagcccagtgtccacccacagattaatggataagcagaatgtgctctatacatacaatgagatattattcagctttaaaaaggaagaaaattctgacacgtggttcaacatggatgaaacttgacatgtgctaaatgaaatgaaccggtcacaaaaaacaaatactgtatgattctacttgaatgaggtagtcaaattcatttatagaaagtagaatgttggtggccaggcacggtggctcacgcctgtaatcccagcactttgggagaccgaggtgggcagatcacttgaggtcagagtttgagaccagcctggccaacatggtgaaaccctgtctctactaaaaatacaaaaattagccgggcatggtggcagttgcctataatccctgctacttgggaggctgaggcacaagaatcacttgaacctgggaggtggaggttgcagtgagccgagatcacaccactgcactccagcctgggcgacagagtgagactccatctcaaaaaaaaaaaaaaaaagaaagaaagaaagagtagaatgggaatggtggttgccacggtacagagtttcatttttgcaagataaattctagagatggatgatggtgatggttgcacagcagtatgaatggccactgaaatgtatgcttacaaatggttaggatggccaggtatggaagcatgcccctgtagtcccagctactctgtagtctgaggccatgagtttgacaatcacatctgtgaatagacactgcactccagtccaggtaaaataacaggatcttgtctcttttttttttttctttttgagccagagtctcgctctttcaccccggctggagtgcaatggcaccatctcggctcactgcaacctctgcctcacgggttcaagtgattctcctgcctcagcctcctgagtagctgggattacaggcacgcaccaccatgcctggctaatttttgtattttttagtacagacggggtttcaccatgttagtcaggctgatcttgaacccctgacctcgtgatccaccccccgcccctcggcctcccaaagtgctgggattacaggcgtgaaccaccgcgcccagctagaaaaaaataattttttaatagttgaacaacaaaccacaaaaaaattacagaggcctttagacaataattttaaggaaataaatgtaaatttgggggactgggtgtggtggctcaagtctgatcccagcacattgggaggtcaaggcaggcagatcatttgagctcaggagttctagaccaacctgggcaacatggtaaaatcccatctctacaaaaatacaaaaaattagccaggtggtggcgcacgcctgtggtcttagctactggagaggttaatttgggggtgaggcaggaggatcgcttgagccagggaggtggaggttgcagtgagccttgactgtaccactgcactccagtctgggtgacagagcaagaccctgtctcaaaaacaaaaaaagtagccgggcgcggtggctcacccttgtaatcccagcactttaggaggccaaggtgggcggattgagaggtcaagagatcgagaccatcctggccaacatggtgaaaccccatctctactaaaaatacaaaaatcagctgggcatggtagcgcacgcctgtagtcccagctactctggaggctgaggcaggagaatcgcttgaacccgggaggcagaagtctcagtgagccgagatcacaccactgcactacagcttggtgacggagagagattccatctccaaaaaaaaaaaaaaaagcaaatttggaaaagcttttatgaacaaagatggccattgtcccaaactggaaacccaaatgtctaacaataaaggaatggctgctgtaacagaatgtctgattaaaaacaaaaggacgccaggcacagtggctcatgcctgtaatgccagaactttgaagggtggatcacttgagctcaagagttcgagaccagactggcaatatgatgaaacccagtctctgcaaaaaacacaaaaatttagctgggtgtggtggcatgtgcctgtggtcccagctgcttgggaaggtgaggcaggaggatcgcttgggactgggaggcagatgttgcattgaggtgagatcatgccactgcactccagcctgagtgataaagccagactgtctccaaaaaatccaaaaggctgaggtgggaggattgcttgagcccaggatttcaagagtgtagtgagctgtgatcgcatcactgcactccagcctgggtgacagagtaaaagcctgtctcttaaaaaaaaaaaaaaagttaaaatggtataataaatgccaggcatgtggctcacaccagtactcccagcacttcgggaagccagagcaggaggatcgcttgagcccaggagtacgaaaccaacataggcaacaaagcaagactccatctctacaaaaaatcaaaataaaaataaattagctgggtgtggtagcgcatgcctgtggtcttagctactcaggaggctgacgaaggaggatcacttgagcccaggagttcaagactgcagtgagctatgattgtactgccgcattctagcctgggcaacaaagaaagaaccccatctctaaaaaaaaaaattaaataaataaaaggagggctgtaacaacatggcaaaaagtttactgggcatctttttttattttttttttttgagatggcgtctcgctctgtcgcccaggttggagtgcagtggcacaatcttggctcactgcaagctccacctcccgggttcacaccattctcctgcctcagcctcctgaatagctgggactacaggtgcccgtcaccacacccagctaatttttttgtatttttagtagagacggggtttcaccgtgttagccaggatggtcttgatctcctgaccttgtgatccgctcgtctcagcctcccaaagtgctgggattacaggcgtgagccactgcgcctggccctgggtatctttttgcctataataaagccagccatctaaaaacagttcaagccctggctctggtacctgtcagctgtgtggccctgggcgggtccctcactctctgtgagcctcagttgcctcacctgtgaaatgtaactcagtggttgagtggatcaagtgaagggctgtatgtcaagcccctgtcaagccacctggtgctccgtgtcctgtggatggtagctgccctgaagcgggactttgcagactgaagtgctgtctcttcagagggagtgcaggtgtccggctcctggtgtgggagaggcaccctgtgctccctggcccgtgagacaagattgggtttgggggccagggcaggagtaggggcccgtcaccaggggaaacggctcgtggtagagcagctgaggtgcagctgggcctgtggcctagaaggcagtcttgtgggtgcctcctcccccagccgcaactcaggtctgcagctgggtcctgcctccttccgagtgggccatggccggtacatggctgctacttctcctggcccttgggtgtccagccctacccacaggtgagccccctctttgccttcctctctgtccctcctcagtctgccgaagcccatcccctcactctggacctccctgggtactgatgggctgcagggaggcaggacaagagatatttagggacctctggggagggtccctctggggaggggacctctggggaggggaccctatatagagggtccccactatactcttcccattgtactcttcctcccagccaccttgctctggggctcctatgtcctcctgccctggagcccacagtgttgatagggaggctgcccctcttagaggtatagagaaatgagaacaaactggatggacatccatagaaggtggggttagggtagccagtgtgtgtgatgtgatatgcaatgatgtcatatgggtaacagtgtgaggtcctgtcctgtccttcttgccctcaggatgcctgccctagttcaataggactcagggtgtctcaagttcactcacagctcacgcttatcagtgggctcaggataggacccaaggcctcttcccagggtatttacccccagccctcccatgatcaaggctggagccaaaggactcatgttttgaggggaaaattccagcttcatctagaagcatgtgcatgtgtgcatgtacgtggtgggggaaggtccatgacttttgagtcaggggggtctccttgatctagagctggccccaagtatctcacaggcactccttcattagggagataaaccacacctatgtggaacacagggagcccatggcaggaggcctgagctcgggaaggaagtaaccagggtaagcagggacaatcctgggatgcttcatggaagaagtggaagctgaactcaacttggggaatgtctctatctatataactgaaaaggctctggaggttgagtcctggagctcgtgcccagccttctctactacctttgtttgcaatgccttattaatattaatatcaacaattgcactaatacttatctgccagggcattttacacttatggcctttactcttcacaacaattttgctgggctggtattattaacagcattatattattattattattattattattattattattattattatttatttttgagacagagtctcgcactgtcgcccgggctggagtacaatggtgtgatcttggctcactacaacctccacctcccgggttcacttgattctcctgcctcagcctcccaagtagctgggattacaggcacctgccaccacgcccagctaattttttgtatttttagtacagacggagtttcactgtgttggccaggctggtcttgaactcctgacctcatgatccgcccgcctcagcctcccaaagtgctgggattacagacgtgagccacctcacccagcccgttatattattattattattattattattattattattattattattagacagagtttgctctgttgcccagattggagtgcaatggcacaatctcaactcactgcatcctctgcctcccaggttcaagcggttctcctgcctcagcttcccaagtagctgggattacagccgcccaccatcatgcccggctaatttttgtatttttagtggaaacaggggttcaccacgttggccaggctggtcccgaactcctgacttcaagtgattcacctgactcagcctcccaaagtgctgggattacaggcataagccactgagcccggcctaacaccattatattgatgagaccattgggactcacaaaaaatattgttccttcaacctaaataaataaataaatacatacataatgaaaacaaaacaaaacaaacaaaaagagtcagaaaattggctgggcgcggtggcttacgcctgtaattccagcactttggaaggccaaggcgggcagatcacttgaagtcaggagtttgagaccagcctggccaacatgacgaaaccccatctctactaaaaaatacaaaaattagctggacatggtggcaggtgcctgtaatccagctacttaggatgctgaggcaggagaattgcttgaacccgggaggaggaggttgcactgagccaagatcccaccactgcactccaggctaggcgacagaaccagaatcagtctcaaaaaaaaaaaaagccaggcatggggctcatgcctgtaatcctagcactttgcactttgggaggctgaggcaggtggatcacgaggtcaggagttcaagaccagcctggccaagatggtgaaaccccatctctactaaaaatacaaaaattagccacgcgtggtggtaggtgcctgtaatcccagctactcaggaggctgaggcaggagaatcgcttgaaccccggtgggtggaggttgcagtgaacagagatcctgccactgcactccagcctgggcaacagagtgagactccatctcaaaaataataataataataataatgaaataaaataaagactcagaaaattaagtgaatgagtcaggagtcacgcttagctctgtctgaagctatgtcctagacggtccactgtgtcacatggcaaaatcttagtcatccttcaaagtgagatggtttaggggatttggagtcacagagatctgagagttcaaatcctgaatggacaacttaccatttatgtgttagtaggataatttttttttttttttttttgagacagagtctcgcactgtcgcccaggctggagtgcagtggtgcaatcttggctcactgtaagctccgcctcccgggttcacgccattctcctgcctcagcctcccgagtagctgggactacaggtgcctgccaccatgcctggctaattttttgtatttttagtagagacagggtttcaccatgttagccaggatggtctcgatctcctgacctcatgatccgtccacctattttttttttttttaattttttgagacagagtcccgctctgtcgccaggctggagtgcaattctcctgcctcagcctccagagtagctgggattacaggcgcgtgccaccacgcccggctaattttttgtattttagtagagacggggtttcaccatgttagccaggatggtctcgatctcctgaccttgtgatctgcccacctcagcctcccaaagtgctgggaataaaagcgtgagccaccacgcctggcctaggctaattatttggcttgtaagaaatctttcctaagtaccctttacccctacatcctcacaagattctctggcctccttccctgcactctgggacatttctttcgtttggctatacctaattcacaaaaaactgcaggctggacaaagtggctcatgcctataatcccagcactttgggaggcccaggcatgaggatctcttgagcgctgaagttcaagaccagctaggacaacatagtgaaaccctatttctacaaaaaataaaaaataaattagccaggtatggtggcacgtgcctgtagtccctgctactgggaaggctgaggtgggaggactgcctgaacccgggtggtcaaagcctcagtaagccatgatcatgccattgcactccggcctgggcaagagagagagactctgtctcaaaaaaaaaagaaaaaaaattacaatgttcaaaaataacattctgggccaggtgcggtggctcacgtctgtaatcccagcactttgggaggctgaggtggaagaatagcttgagcctaggagtttgagaccaccccaggcaacatagggagacccatgtctctacaggtattttaaaaatgtagccgggtgttgtgacacgtgcctgtggtcacagctacttggcaggccaggaggtcaaggctccagtgaactgtgatcacaccattgcagtccagcctggatgacagagctagaccctgtctcaaaaaataataataataggccgggtgaggtggctcacgcctgtaatcccagcactttgggaggtcgaggcaggcggatcacgaggcaaggagatggagaccatcctggctaacacagtgaaaccccttctctactaaaaatataaacaattagccaggcgtgttggcgggcgcctgtagtcccagctactcgtgaggctgaggcaggagaatggcgtgaacccgggaggcggagcttgcagtgagccgagatcgcgccactgcacttgagcctgggcgacagagagagactccgtctcaaaaaaataaaataataaaaaataataaaagattgtgggaaatagggattattttggaaaatataggaaaaatgtttgtagtacccatatgacttagttctttcttttatttttattttttttgagacggagtcttgctctgtcgcccaggctggagtgcagtggcgcgatcttggctcactgcgagctccgcctcccgggttcacgccattctcctgcctcagcctcccgagtaaatgggactacaggcggctgccaccacgcccggctaattattttgtatttttagtagagacggggtttcaccgtgttagccaggatggtctctatctcctgacctcgtgatccacccaccttggcctcccaaagtgctgggattacaggcttgagccacagcgcccagccatgacttagttcttaagattattaaataatacacctatacttcaaatgggtgaattgtctggtatgtggactatatctaaacaaagcttttttttttttttttcactctgtcacccaggctggagtgcagtgacgcgatctcagctcactgcaacctttgcccgggttcaagcgattcttgtgcctcagtctccagagtagctgggactacaggcacgtgccaccacacgcagctaatttttttgtatttttagtagagatggggtttcgccatgttggccagggtgttctcgaactcctgacctcaggtgatctgcctgccttggccccccaaagtgctgggattacaagcatgaaccaccacacccagccttttttgttgttgttgttgttttgagacagaatcttgtgctgttgcccaggctggagtgtagtggcatgatcttggctcactgcaacctccgcctctgggtttaagcgattctcctgcttcaagcctcctgagtagctgggactacgggtatgcaccaccacgcccgactaatttttgtatttttagtagagatggggttccaccatgttggccaggctggtctcaaactcctgacctcaggtgatcgccctgcctcagcctcccaaagtgctaggattacatgcgtgagccaccgcacccagccaacaaagcttcttttttttttttttttttttttttgagagagagtcttgctctgtcgccaggctggagtgcagtggcgtgatctaggctcactgcaacttccgcttccctggttcaagtgattctcctgccgcagcctcccaagtagctgggattacaggcacacaccactaagcccacctaatttttgtatttttagtagagatggggtttcaccatgttggccaggatagtctcgatctcctgacctcgtgatctgcccaccttggcctcccgaagtgctgggattacaggcatgagccaccgtgcccggccaacaaagctttttttttcaaaaaaaaaaaaaaaaaaggctgggtgtggtgcctcacgcctgtaatcctagcactttgggaggccagggcgggcagatcacctgaggtcaggagtcagagaccagcctgaccaacatggagaaacccagtctctagtaaaaacataaaaataaaaatgaactggcttggtggcgtgggaacttgggaggctgaggcagaagaatggcttgaacccagaaggcagaggttgcagtgagccgacatggtgccactgcactccagtctgggagacgtagcaagactccgtctcaaaaagcaagcaaaaaaacaaacaaacaaaactacaggctacagaaaaaggctgagaataaaagaaaaaatacccaagcacactccacctagattaacaaacgtttaacattttgccatatttaaatcagacttttaaaaaaagaaacaaaaagttacagatatatttgaagccccttctaatctcattccaggtcctgtttccttcccttcctcaccagaggctgccacaacagggtattacaagtattttttttacacatctactgtctttcccatggaactgagttccttgagagcagggacaatgacttacccaatgttgtatctctagttcctggaacagaaaggggctcggatatcatagacaagtggatggaaggagaggtgggtagatggatagatagacacatagatgaaaggtagaaagaatagatggaggtggccgggcatggtggctcacacctgtaatcccagcactttgggaggacgaggcgggtggatcacgaggtcaggagatcgagaccatcctggctaacacgtctctactaaaaataaaaataaaaattagccgggcgctgtggcgggcacctgtagtcccagctactcaggaggctgaggcaggagaatggcatgaacccaggaggtggaacttgcagtgagctgagatcgcgccactgcactctagcctgggcaacagagcaaaattccatctcaaaaaaaaaaaaaagaaagaaagaatacatggaggatagatggctgatagaagaaaggatggataaacaggtgagtgaatgaaaggatgggcagatggagggaaggaagggtggctagatgggaaaatgcaaggaggaatggatgagtggctagaaggacatgtagatggatggtggaaggatggatggatggaaagacagaaatgtagaaccctagcctacaacacaatgctggcctgggaggccaaaagctggtctagcacccacaggtacatgctctcttgcaggtgtgggcggcacaccctttccttctctggccccaccaatcatgctgctggtggatggaaagcagcagatggtggtggtctgcctggtccttgatgttgcaccccctggccttgacagccccatctggttctcagccggcaatggcagtgcactggatgccttcacctatggcccttccccagcaacggatggcacctggaccaacttggcccatctctccctgccttctgaggagctggcatcctgggagcctttggtctgccacactgggcctggggctgagggtcacagcaggagtacacagcccatgcatctgtcaggtggggatggagcctgggcccttgcggatgctccctgtccccttccacacaccaggatatggttggagggagggcaggctccaggccacaaaggcatgaagggtgtccaagcgcagagcctctgggtgaggtgacacctgggctcaggggagagtggcctcagggccatgaattttgggatttgccactgcaatatctgtttgaaatccaggctttgcagcatggcttccaaggataaaaatgcctccttccacctaggattcattatacacacatagataatcaccctgtgtacatgacaccctataaggaccaaactaattaacaaatcactaccagttattgagtgtttactctgttccaggcagtgttctacagacttcacatttatgagacaggtcatataattccctcaattttacaggcacagggaggttaagcaacatgtctaaagccagctatttttgtttccccctccattgtattttgaaacagtcagctattattatcactgaccagatgacttacttcctctctagggattatctcaattttgtcatctttcaaatgggaatgtttgttaactaagtgccctgacttccaaagaatgctgcgaagacagtcagttccttatctgagagttccgggctccccagcctccccagggcacagaacaggggacactgcaaagtgagggatgtttgggtcttcagaggacttgcagcaaatgggctcagggtttctgctgctggctcacttgtccatttaccccaaatgcctcgacacccaccctgtgccagggcctgggcatagcactggggatgccctccagagtgcatggcccatccccaaagactcattcgcttctccctggacaacaggagaggcttctacagccaggacctgcccccaggagcctctcaggggtgagtactccgggcaaggggtggggaataagaggctgggaccaggaccttgggcccggggggtggggccttcagctctggcctaatgggtcttacactggaggtcagtaggtgtcccatgtagaggctgtcatgctaggttggggcactggctagcatgggcctcagtctacctagcataagatgggggtgaatcctttgaccccagcctaattcctggacattagttgagaagcacaggtgacagctaacagaggggtctttggagtcctccttgggcagcccaggcaggggggtctcagcattagaggccgtgtaaatgggaggctgtctggggtgatggaaagagcctggacggacagtcatgaagttgggctgtggtccaactctgcttcccgaccaaatagagaattttgaggccgggtgcggtggctcacacctgtaatcccagcactttgggaggccgaggtgggtggatcacgaggtcaggagttcgagaccagcctggccaacatggtgaaaccccgtctctactaaaaatacaaaaattagccgagcgtgatggcacacgcctgtagtcccagctactcaggaggctgaggtagaagaatcacttgaacccgggaggtggaggttgcagtgagatgagatcgtgccactgccctccagcctgggtgacagagtgagactccatctaaaaaaaaaaaaaagaattttgagctagttactctctgcatcagatgctaattaattcctgcgtggcccccacccctacccccatgattgttggggaataaaataaaatgaaggccaggaaggtatgtattattaccagtaagaacggaggctagacaccgggaaggactttccctggaggagggggtgaaggggacgggcaagggcagaggacaaggccctctccgccgttctctcctggggtagggggctgcgggctcctgcgggctcctgagcggttcctcctcgcagggacaccgggtggggcgctgtggctgggggtcctgcggctgctgctcttcaagctgctgctgtttgacctgctcctgacctgcagctgcctgtgcgaccccgcgggcccgctgccttcccccgcaaccaccacccgcctgcgagccctcggctcccatcgactgcacccggccacggagactgggggacgagaggccaccagctcacccagaccccagcctcgggaccgccgctggggtgacacccctccgggtcggaagcccgggagcccagtatggggggaagggtcttacctcagcagttaccccacttgcccagcacaggcctggtgctcaagatctgccctcagggctccttcctccagtcttggagcattttttgcaggtgacctgcctcctcctctgcaggctggagctgcctgagggcagggctctacctcccctgcgtcacactgtgtgaggctgtgtctctgccatccaaaagggggccccttgagaatggtgatccacccagttacaggggcatttagggagcagatgactgagaacattaaaaaagaacttaaatgacacagcaaatgaaaaatatttgaattcatgtctatcctgggaggaaggaatttggcagagttagaagtaggaaaaatccaggaaagctcccttgaggaagagggcttcctgagacagaacttgggaactgcagagtgggactggtggctgggaaggcggctgtctcctcccccaacagcaagcggggaggccccctcttctcctcaccctggcccaacctctgtgagaggtcagggcagagagcccaggaacccaggaaggtgggtggtgggtctgatgtgaactctcgtacagaggtgaacagggccagggtttctggggaacaggatcgttttcaataacaagagtatgagatattaattccaaacttacagtttattaatcaattaagagtcattattcatttgacaaatattctttaagtatcaaccctgagccaggtactaaagaggtttggcttttttggtctggttgttacataaagaagattcttgtattgatcaagtatgaggcttccacagtagagcataacgtgtgcgtcccctgcttgcccagcgctggcaggaaatccagactttcccaagggttctctgctagtaatcactccaagagactctgggtgctgtcatgtaaatccacctgtcccttgggccccataggatagtctgctggatcaactttagtcttccttcccccagggaggggatggggaactatgccccagcaccccaacacatggtttcaaggacaccctcagctcccctgagcctctgtgctctctcagctactgttccataaaaactctcactgcctcctccactgctcatctctcaccagcctgaaaggagattctcccacttgttttggggattcttgggtgctggtggctggggtgggagggtcccatagcttctacggatgaatctgtccaccatccccacaaggcatgttccttctctgacacacagactgagggagggtgtgggcaggggcccaactatagcctcagactttctctggccactatcccttcctagctgtccggccagatgctgagcccaggcttctcaatctccactgtcaggctggcttaatcttatttcccaggagggcttctgagccgaggtgaatcaagggccatggccaagctctgagcctacccaagtattttattttattttattttatattttattttattattttattttttgagatagggtctcactctgtcccccagggtggagtgcagtggtgcgatctcaactctctgcaatctctgtctcccaggttccagcaattctcccacctcagcctctcaagtagctgggactacaggcacacgccaccatgcctggctcatttttgtattttttggtagagacagggtttcaccacattggccaggctggtcttgaacttctgacctcaagtgatccgcctgccttggcctcccgaagtgctggaattataagtgtgagccactgtgcccagcttgagccaacctaagtcttatcaagcctagaaaacatggaggaccttaggagggtgtcctgatcttgtacactgtggaattccacatgccacagcccctgcctatccaaagtgctttgttaccaacacagttttggacaagaaactaaagtcagaaagtggcaaggcctgggcctcagtgctctgaagtcttcataaaatagcataaatatccaacctctaggaaggaaacaagaaggtatcagggaacagggttttatggccaatttgcagacaacttcccagagaagcaactttggtctgtgtgcgtctgtaggacactgagttcaggggcagcctaaagaagaccaagagtgctcctctttatttttatttgtttatttttattttttgagacggagtctcgctctgtcgccaggctggagtgcagtggcgcgatctcggctcactgcaacctccacctccagggttcaagcaattctcccgcctcagcctcccaagtagctgggactacaggcacccaccaccacggctatttttttttgtatttttagtagagacagggtttcaccatattggccaggctggtctcgaattcctgaccttgtgatctgcccgccttggcctcccaaagtgctggaaatacaggcatgaaccatcgcgcccggcatttattatttttgagatggagtcttgccctgtcgcccaggctggagtgcaatggcgtgatctcggctcactgcaacctccatctcccaggttcaagcaattctcctgcctccacctcccgagtagctgggattacaggcgtgtgccaccacgcccggctaactttttgtatctttagtagagatggggtttcagcatcttggccaggctggtcttgaactcctgacctcgtgatccacctacctcggccttccaaagtgctggaattataggcgtgagccaccaagcccggcctcctctttattttttattttgatttatttatttttgagatggggggggtgtctcgctatgttgaccaggctggtctcgaactcctggcctcaagcagttctcccttcttggcctcccaaagtgctgggattacagacattagccacggcgcctggcctttttcttcttcttcttctttgttgagacagggtctcaatctgttgcccaggctggtctccaactcctgggctcaggtgatccttccgcctcggcctcccaaagtgctgggattacaggcgtgagccattaagtgttccccttaatgacacagcagatgagagttttactgagtatctccttgtgccaggcaccctgttgttgctggggaagcggaagggagagacaatcgttaatcggctaaatttctgccttctgagagctcagaatcaagaaataaataatagggcagtaaaaggggctgggattacatacaaaaagaaaattaatgcctgaactttttacaatctgctcgataagctttaattctattaacctatttgagcttcccaacaacaggcaagctcccacagcagctaggaggatcactttgtcgtcatacaaatagaaacaggctcagagaggaagtcatttgttctagttctcactaggacaaatctactggctactaaaaaagtgtgaaggctggggacagtttgagtcgtcctgcttgcaccttaagcgcctacaagagtgcccggctataacaaccacaataccaataataaaatttaaaaacagatgttcagtaaggacttgcggcattaggaccccaggagggaagtgacgttcgaggaggcggagaaagccgcgaagacggccttccccacatcttccagcacctgcgcgcctgaatccgtcccacccaggcccagacgcaggcttcttctcgggtcttggtcctgcatcctctctctcccagagcctccgttagggggtgggaaaggactttgccataggtcgctgaggccaccatctgctctcttactggccaagggcgtaaaaagatagtcttcccattagctagagagcaaaccccagaaagcctattggctgcgccgtccgcgggccttggtccgctttgaaggcgggctgcggctgcgagaggagggcgggcgggaggctagctgttgtcgtggttgctcggaggcacgtgtgcagtcccggaagcggcgaggggaaactgctccgcgcgcgccgcgggaggaggaaccgcccggtcctttagggtccgggcccggccgggccatggattcaatgcctgagcccgcgtcccgctgtcttctgcttcttcccttgctgctgctgctgctgctgctgctgccggccccggagctgggcccgagccaggccggagctgaggagaacgactgggttcgcctgcccagcaaatgcgaaggtgaggaggcggggcccgtggggcgtatcctgccggaggggctggctccagcggtggtgcttgcggagcagcgtcgggggttgcaaggttccgagctctgcagggtgtcttccttccttgaacaggcttgcgccgggacgctgcggcggacgagagatctggtcccggtacccctggagttcacacattggtagaaacaagcaatgataattcagagtagtagatgccatgataggggaggtacagagcttccttttgggggccggacgaggagcatctggtctagcctggagtgggggagggggtgggcgaaggctgtgtgcagaggggagtcaaagagggcttcatacaggaagcacgaagaggcattaggagttagccggatgaagagaagtggaaagagaggggcccactcaggaaactacagaggcagaggcctgccggctgagaagctaagaacgagtttgaggaactgaaaagctccagatgactcatcttgggggaaaaaaacctaagactttccccttttgccctcactgcaacccaatctgtgtagttgtctgttgcacccactaacaactcctcgaaggcaggaatttttgtcttagatacgtattcacacagtgtctggtaggcactcaataaatgttttgagaatacagatgattaaatgggagactgtgggtgtgtgtgaggaggaggatctggatctgaggagccctttgggggaacaatagagcctatggggaacttgaaagaagattttaggactttggagaaaaggtgagtcccaaagacataggcgttgaggaactacagagagagagagagagggagctaccagcgagccaggactataaaggacctatttctttttcctcaactccgtcccttagttttctcctcagaccttacagtcatgcctgccttcctagccccgtaaccccagggcccccagaaagttggctgtgaatctctcatctgaattgaaagcctacatcaggccagatgttccctaaacactggaaagtgggtttggggtaagtttcggacacataatccttccattagagagattaaaaggatgctttagagataagccgacttcactggtagggcacccagtatgagttcaagcctgtgccttcccccgtacattcttttctttttttccttttttttttttatgagactgtctggctctgttgcccaggctggagtgcagtggcgagatctcggcttattgcaacctctgcctcctaggttcaaacgattttcctgtctcagcctcctgagtagctgggattacaggcgcatgccaccatgcccagctaatttttgtgtttttagtagagatgggatttcatcatattggtcaggctggtcttgaactcctgacctcaagtgatccacctgccttgggctcccacagtgctgggcttataggcgtgagcctctgctcctggccgccctttcacttttcgctcttcctctagtcctgatagcttttttttttttttttgagatggagtttcgctcttattgcccaggctggaatgcagtggcgcgatcttggctcaccgcaacctccagtgacccaccctcctcggccttacaaagtattgggattacaggcatgagccaccgtgcctggccttttttttttttttgagacggagtcttgctctgcccagtctggagtgcagtggtgcgaccttgactcgctgcaacctccgtcccccaggttcaaggattcttctacctcagcctcccgagtaggtgggactacaggtgtgtgccaccactcccggctatttttagtagagacgggttttcaccatgttggccaggctggtcttgaactcctgaactcgggtgatccacccaccttagcctcccaaagtgctgggattacaggcgtgagccactgcacccagcccagctaactgatagcctttcagcgtttcgcttcctcttctctttcttttctgtcttattattattattattatttttttttgagacggagtcttgctctgttgcccaggctggagtgcaatggcacaacctcggctcactgcaacctctgcctccagggttcaagtgattctcctgcctcaacctcctgaatagctgggattacaggcacctgccatcatgcccgggtaatttttgtatttttgtagagactgggtttcaccatgttggccaggttggtcttgaactcctgacctcaggtgatcctcccacctcagccttccaaattgctgggattacaggcatgagcctccgtgcccagcctgtattctgtcttattctgatatcaaagagcccatactctccctcttattattctcatagcctaaggagctcacatttattctccttaggcaacattcacagactcacggaagcatagagatgcccaggatctctatatctctatatctagagatcattctagtctaccctcatttggtaactgatgaagattaattgaaaagggatttgcagtcacaggatggcttggcaaactccaaccgttaggttcatcttaatagtatatttgtttgtattattattacacctttgttattaaatgctgactgtgtctagcccaccaagcctgcctcctggctcagtagcctgagtggaacaggcctcggcacagaggaaggagaacctgcccggaaaaaaagagtgggtggatgtcagtgagggtctggtgtctgtgccgtgaatctcctgtgagtctggttctgggtgggatccgcagaggaggtcttgaagaggtaatgtttggaagagctggaaagcaaggctgtggttgatgggtatgagagagaaaggatgttccaaacctcccctttccccactcctggggagggcgtgggaggaggggcaagtggtgctagaaaaatgatgtgcctgcacagagtacaggacagaagaggggagggagcccagatggtcctggatggagagctggggaggtgagacatccccagttcattgcagacttgaagatcaccagcttattacttggaatttgtatgtgtttcaaattctccaagccattgattaatttcaccaagcaggcctccaggggatgtatttatttttgtggtaaattggtattctagcagactgtgctgtcagtgttaaaactgctgatggcatttagccttcagactggtattccattcagaggcatcagaagacggtctctatcaacaagatttatcgagcgtccagcatatatcaagtcccaggctaaggaaatacgaaaaaatctaatacataatgcacattttggggacccttgtggtctatgtggagagacacatcaaatgactgagggtccttagggagagcatggatcctgcagaggcccagagtgaaatctagagcaattggcattagtgcagaatggcttcctgggggagaggcttataatgcgaggtgggcaggatgggcagagaagcccttagaaggcattaagtattttcctagggcctcaggcacttcacaccctcggtggtagcactgtagcactctatacagtggtagttatttgtctacacctttatctgctgcattagactgagtatctggaagggaggggaccttgttttcatctctgtatccccaggctgacacgtaggagttgcctaatacctatttgaggaagggtaagaggaaatgaggaaataaatgtgcggagacagtaggaacaagagctctctggagggcatggagcaaattaacttggtagaaatagagctgatgttggaacacatatgaaatcaagtaatctaacaaccataaaagatgttttggggacaattaaggaaatttgaatatggactactgggtgatgttggaattgttaattttccaagtatcataattgttctatggttatgtaggaggaggtcttttttctcaggagatacatgatgatatatttatctcaaaaggtcatgtttgccacttactttcaagatggtgtagcaaaagaaatgtatatattgttgagatattataattatatattgaagagagaatgtggcaaactattaacaactgttgaatacaagtggaaggtattcattgtgttctttcagcttttctgtatgtatgcaattttagaaagtaaaatgatagaccctggcgtggtggctcacgcctgtaatcccagcactttgtgaggccgaggtgggcggatcgcttgaggtcaggagttcaagaccagcctacccaacaagatgaaacctgtctctactaaaaatacagaattagccgtgcatggtggtgcatgcctgtaatcccagctacttgggaggctgaggcaggagaatcgcttgaacccaggagctgagatctcatcattgtactctagcctgggcaacaagagcgaaactccatctcaaaaaaaaaaaaggaatacgaagaacaattgcttaagggcaggatttacagtaagtacatgctcttacacaagaaacagtagataaaatagaaatcctagaggcattcctgaaactggggttaatcagaagtcaacatggcacattagcatccaagatggagttgctttagcctccacaggttctaactccttccctgccttgagtgctgattttggtcctccagtctaggaaaggatgcccacctggatctgttttgctgggagctggcctcccattagactcatgtgcactcagtgggctgtgctacctccctcccccagtgtgtaaatatgttgctgtggagctgaagtcagcctttgaggaaaccggcaagaccaaggaggtgattggcacgggctatggcatcctggaccagaaggcctctggagtcaaatacaccaagtcgtaagtgaatggggactcactggcctggcctgcgttgctgctggaggcttcaggggtttggagttcccttctcctagctaggcaaaccccctacaagggcatcatttgtaaccaagacctgagtttgcccactgattctgtccccagctaattgggtgacgtgcataaatctcttaacttctttatgcttcagcagatttctcatctctaaaagcaagactgttggactatatcattgattctcagacgcttggatttcacagagcaatgcaagtttttttttgcgacggagtttcactcttgttgcccaggctggagtgcaatggcatgatctttgctcactgcaacctctgcctcccgggttcaagagattttcctgcctcagcctcccaagtagctgggattacaggcatgtgccatcacgcccagctaattttctgtatttttttagtagagatggagtttcaccatgttggttaggctggtctcgaactcctgacctgagatgatccgcctgcctcggcctcccaaagtgctgggattacaggtgtgagccaccacacccggccacagtgcaattttttaaaacattagtaacaggattaccagctttttattttgctaggtacaaatatagtttttaaaaacccaattctgtcagctgtgatcatcctttcaaagagaatgatattttactatcaaaatttaataattttgctttatcaaaaaatctaaatactgaatcatttagctttataaaaaattccttcccttagagctgttaaaattttgtctctctggtctgtgttccagcatttcagatcccccagaccagatgacctatcttccttccagctctgagtcacttcccattggtgagatgtgcaggtgttggggcacagggctggagggacagaccactaacccactgcggctaggaggggaactcagttcctcatcctcctgtcttggcagggacttgcggttaatcgaagtcactgagaccatttgcaagaggctcctggattatagcctgcacaaggagaggaccggcagcaatcgatttgccaaggttggattcgggattgtccttcatccgctctggggtcaggcctgcatgtatcttagtgtgtctgctggtgtgagtgtgatttgaagatgaccacctgggatcttccttcattgcctcttcccattctttgattgccgtttgtgctcctcccctcttgagtggcct

SEQ ID NO: 467 - DNA, 38996 bp, Homo sapiens
cagggtctccctatgttggccaagctagcctcaaactccaggcctcaagcaatcctcccacctcagcttctcaaagtactgggattataggcatgagccacctcgcccagcctgataatttttttcttttttttgagacggagtctcgcgctgttgcccggactggaatgcagtggtgcgatcttggctcactgcaacctccacctcccaggttcaagcgattctcctgcctcagcctcccgagtagcagggattacaggctgataacttttttttaaataaaagatctcacctatgtattactgaacccagcctactagtgcagagcatatgaacaaagagaaaaagtaccttcccaatcaaacatgtccagctgtccagatagtggtgacattttcagcttgctatggtaatatgatcacaaccttgatacaacatgaatatgtgtagcatctcatgctcaattccttatagacccagcttggttctttccaatatctccttttggagctgtacctgatgttattaccagttttcatacagatccactggggaatgggacaattttgcttttgtttcttgtgcaggaatcacttgatcctgaaagtcttgtgagaagctgtggcgagaaacggagtcaaccacacaccacgatggtggagaaagataatgtttaacttataaattaggcacagttaagagacgaacagcaataattaataatacaatatacaataaaacaatataacaatatatcataacagaagttatatgatggtgacctctctgtctctttttctttcaaaatctattaatatttttagactgtggttgaccacaggtaactgaaactgcgctaagtggactactgtagcgctgaaaaggtttgtaacagcaaaaaacagcagtcctcccccatccctcccacccccccatcccacaggtaatcccacccgctcggcaattgctccctcagttaagctctttctcgctaaatatcatattgatttttttatgtcttaatccctcaattttacccattatctactgactcctcttacagtacaggagaagtttacatttcttacgcactctcaccccttctccccatcttctcaatatgagtttcggttaaatgcatatccagtgttcccatgattaatgcaatgtaaatattatttcctgctcagccaggagttcataattgcttcgttttttggtttttaaaaatatcttcgatttcttggactaagcatttccacacgttcctatagcttcgtaaaaaccacacagtggagtttccagagtccagcctcagggacgatttcgtcctggagactgacgagctcctcttatctgggccagctgccccttgggcctgtgcgcagctgacatcccgagattctctctccattgttgtttggggattcccttcagctttttcctgtatgaatccagttccttagattccatgtcttcctttttgatgttttactctctcattttatgggggccttggggtttttttgttttgttttgttttgtttttgagacagggtcttgctctgtcacccaagctggagtgcagtggttcaatctcggctcactgccacctctgcctcccaggcccaagcgatcttctcacctcagcctcttgagtagctgggactacaggtgcatgccaccacacccagatagtttttgtattttcggtagagatggggttttgccatgttgccaaggctggtcttgaactcctgggctcaagtgatccacctgcctcagcctcccaaagtgctgggattacaggcgtgagccaccgcgcctggcctcctctctcattttgatgtagcatagctcccagtaactttcagagaaggtgtgcatgtttcaaaatagtgaattcccctctcacacatgttgataggtaggctaggtatagaatttgagattgagaatgactctgactcagctgatggaaggcgtctgtcggtgtctccagcttccagcacaattcttaatcccaatccattgtgtaacttaagctaatttttttattattattattctggaatcttctaggatctttgctttatccttaaatttctgaaaattttataacaagatttgattcttttttcatttgtcttcgggggcaccaagtagccttttaatctgaagatttgtgttcttcagttctgagacacatttttctgttatttccttctgtaactcctattatatttgaatattgggtctcctggatgaaatctttattcttcttgttgctcatctttataattttgttctacttcctgggaggtttaaaaaaatctgtttttctcttccagtccctctttttttaaatcaacctatttttcatttccaagagctctctcctgttttttattttatttttttgtttgtttgtttgtgttttttgagacagacagtctcgctctctcactctgtcacccaggctggagtgcagtggcacaatctcagctcattgcaacctccgcctcctgggttcaagtgattcttctgcctcagcctcctgagtagctgggattacaggcacatgccaccacacccagctaatttttgtaattttagtagagacagggtttcaccatgttggtcaggctagtctcaaactcctggcctcaagcaatccatccacctcggcctcccaaattgctgggattacaggaatgagctactgagcccaaccagctctctcctgatttctgcctgctctttgctatggcattctgtactcatttgtggatatatgtttccttatctcttcaaggatggcaatgatggttttgtcaaaattttcttctgctcactgcatcatctttattgcttactgatattccttttcttctacttatttgattgggtctctttcatttatcatttggggcaatgctatcattagagccttcttcaaccagtcatcctgtgttagccactcctgtttcagaatgaggcattaagcccgggcatggtggctcacacctgtaatcccagcactttgggaagctaaggcaggaggatcacctggggtgggagttcgagaccagcctgaccaacgtggagaaaccccgtctctactaaaaatacaaaattagcctggcgtggtggcgcatgcctgtaatcccagctactcaggaggctgaggcaggagaatcgcttgaacccaggaggtggaggttgtcatcccagtagccacagcaagtcacatggccaagcccagcatcaggggagaggggaaacacgcccctcccatagagggtgtgtcaatctctctctggagcatggtaggagtgatgggtagggagggtaggagtggaggagtgattatttgcaaggcatcatcgaattgacatctccaaaagcattgtggtgcctcacccccactctgccctgtagcgaatgtctctgggtccagagaactctggctgaatactccttgctggggttagggaggggtgggtgcctgaccacgtaatggaaaagagaagacctggggtggtgctgggggatctcactcctcctaagcagacttccacacaacccctgttttcagcctcctgcctcaccatccatgatgtctgggttccctaattctaagcctccccagggttctgcaagaccaggtgatttgcatcttttctgtctccaaagcccctactccaccccaccatgtagcagcaggcacttaggtttgccttcctcagctctgttcaatcatttaccaccctccatctgctcttgctgctcatacattgtggtttggggttacaggtgtctcctggcttctttgaaggtgggagtttgtgtttctgtttcttgttctccttcttgtcgtggctgcttttcagcgaggaggtgggggtggaaacatctctaccctagcgccttgagacgagagtctcttcctttctgtattgaatatatttctgtgatctgtggatcaagccacatggtggatgtctatttacacgtctgtctctcccactggcttctgagctgctggtgcgcaaggggctgtgcctcacccctctctgcacctccagctcctgccacagcttggtgtgaagcacatagttaataggtgggaactgtattgaattttggattctgcaaaaaactgctcattttaccttccttgaggtcctctccggaagccttctagggatatcctggatctgcctctccctctccgggacctgtcctgctctgcctcccatatcatgtgagagctggatggagtcagatgtccccaaatgtcagtatctctctggagcgtggtaggaatggtgggtagagaggagaggtcagagatcggaggagcagataacgaagagtctagactccaaaaagtcaaggtttcagtatcagtacctgtgtcacaaaccaccccaaaatgtagtggcttacaatagccatgttattatccctcatgattctgtgggttggctgggctcattcaggccattctttttctttgatggtggctgactgcgagtcacctggagactcagctaggccggcacatccaggtcagctcttgtacatggctggcacctggctggggtggttggaggctgggctcagctgggtcgctggcatggttcagtctctctattttcattaaagtccattctttcacccacttactcatttgtacaaataacattcattctgcatggattaggtggccaggactcactagggccttagtgtaaaacaaaacacgcaggtccttctgtgtgtttgagcttacagtctagacgggaagcactttttgaataaatacacctatttaataaacaattataaacagtgatgaagactgttcttcaacagaggcaccaagagagaagcaggaggaggaggtgatcgagattgagtgtggggtgattgtggaggaagatctgggagagtaggtgctatgtgtggaaggagcggcttgagcaagggtcccaaggtagaaggggcctggcacacagtgaaaatcctgggagcagcctgcattagtctgttctcacactgctaataaagacatacccccagcctggccaacatgacaaaaccccgtctctactaaaaatacaaaaactacctgggtgtggtggcacatgcctgtagtcccagctactcaggaggttgaggcaggagaattgcttgaacctgggaggtggaggttgcagtgagctgagatcatgccattacattccagcctgggcaacagagcaagactctatctcaaaaaataaaacaaaataaaaaataaaagtaaagacatacccaaggctgggtaatttataaaggaaagaggtttaattgcctcacagtttagcatggctggggaatcctcaggaaacttacaattatggcagaaggggaagcaaacgcatccttcttcacatgatggcaggaagaagtgccaagcaaaaggggaaaacccttataaaaccatcagatcttgtgagaactcacgtactatcacgagaacagcatggaggtaatcgtccccctcccccatggttcaattacctcccactgggttcctcccacctggattatgggattcaattacctcccactgggttcctcccttgggattatgggaactacaattcaagaggagatttgtgttgggacacagccaaaccagatcacagcccttgtggctggagctttgcaaggaaagggaagatagtgccaagtgagatctggaggtagaaactgacaacatcctataggccttgtaggtgagggaggaggtttcgtgccaaatgtccagagataccactggacggtgttatacaagggagtggtctgatctgattggtagtttaacgcgatcactctggccactccgtggagataaaccatggccaagggcaagagtgaaaacaagaaggccagtcaggaggtgtgagcattaggattggtgctcagttggtgctcagcaaatatttcctttcctccaagtctgggaagagttcctgtccctgccccattggtggtgttgggctcggccatgtgaagcatgagcagaggccttaaacacctcatggtttggcttggcttctcatgctcctgtgatccacaatgagaaggacatgccccagggaatgctggtctaaggaggatgagagacaggtggagccgacccacacacacccacagccaggaccgagaccacccatccccagcccgaagccaagtcaccagccaaaccctcctaagtcagcagacccactgtccacctacaactagtgagtgtgagaatacaggcctgctgcttcttgcctctggatttcaaggcagtttggtttgttacacagcattattgtaccaattgctgactatgacaggaggctaccacagggaggatacagtgctggtttggacattagaaaccatgacaatgcagagaagggggtcactgaggagattgtcggtgatgggttggaagtggaaggtgagggagaaggtgtcaaggaggactcccaggtttttgatttgagagcctggatgcatttactgagtgatgaaggctgggcggggcgtgtgagtttgaaatgctcaggagacatccaagcagaagggccatttcctggggctctctgctggctggacagcctccccactggcctgtgagctcctgagagcgggctcatgcttgacccacccccaagccttgggcttgacacacggtctcaataactatttgctgaaggattcaatgattgaataagtctgtggttctatcagcatttttgactgcacagttgtttgtaaatgaggaaaatccccaggccacctggtggcaaatggagtagaggcagagagagggaagacaggaggccagtgaggaggctgtggctactgtccaggggagacatggcaggggttaggttagggagcagccgtggggacaaggggtggatttaatagacagaggctgaattgtccaagcttggtggccagtgaatgccagggtgaaaggatcggaggagtttgggggaccccaggcctccgctttgaagaagggacaaggaacagccagtctctagaatagaaagcaccagatgaagtggccttgtctggcaggcactttcctcaaccaccaggccatgatttcattgcaagaaggggcgaagtgaggcatggaacctgctgccagcccaggcctggcactaggtgggcacttgggaggggttgttgtcacatgaaagagcaaaccatggtgtcagctcctgcccacaaccggcaggtcttcctgtttcaaaacaggttctcattgacttcccataagctttctctttcctatatgaggggcctccatcctcagccaatttgcagagcagaaacaagtggctcaccccacttggagtggctgctgggaacagttatacagtgggaagagcactgcgctaggagtcctaccgcttcagtgacaaatgctgtcagcttaccgtaacaaaaggtgtgaccaacggtgacattaacaattgggtggtttcattttcttcagttcccataacaaggcagctgttagcattggctcagctgcccactgctgctgccaggaactcacgctccttttatctttctgctcatcccctctcagcacggggccttgtatcttcatgtttgtggcttcaagctcacaagacggctgctgcagctccagacatcccacctgtcattttttttttttttttttttttgagtcttgctctgtcacccaggctggagtgcagtggcgcaatctcggctcactgcaagctccgcctcccgggttcacacaattctcctgcctcagcctcccgcatagctgggactacaggcgcccaccaccacacccggctatttttttgtattttttagtagagacggggtttcaccgtgttagccaggatgatctcgatctcctgacctcgtgatccgcccacctcagcctcccaaagtgctgggattacaggcgtgagccaccgcgcccggcctgggcctgtcatttttttaaggaagaaaacaactttcacagaagccatctctcccgctgactttcattcacatcggcttctaggccagaactatgtggcctgaaaaccccagtgacaaaaccagctggaaaaacgagtattttgttggtgttaggtacggtgctgctatgcacaaaactaggattctgttagcaaggaggatgggaacagagggagagggtgggaaaggacagcatctgccttgtcaatttgagccaaacctgtgccctcccgcatcctcatctcctcttctgcaaaccgtggctaagagtacctatcttggaaggctattagaacattaaatgagataatatgtgcatgggagccaagacaatgagtaaaggaagttatttactgacattattatcatatagaagcaaagattgtctctactggggtcgacctaacgggctgaacacacatggaaggagatccgggcccacctttgccctgcagggaagttccaggagcaaaggaaaggggtccagtatgttcaaaggcctggaatgaaagaagcatgaatgtggagtggaagaaatgacagtccagtctgatggtagaggcacgagtgcaataagagtgggaggcagaggatggccagaccttcagggccatggtttgttgcggaggctctggagtttatcccaaggctctgtgaagaggagggatcagaaagaggctccctcagactctggccaacctcagggggtgcctcagggatcttagacatcgaacatactagggagtggggtcctggccgcctgcatctgtatggtgccatggatgggtggggtttagtatttcctttctgtttcagaagagaagtaactttgaaaacatcatgactttgagctgaaactaagaaaagcaaaggggtttcccctctgcacctaatcccttttaaggggggctcccaggaggtgagtgagctggagggggtcctgcctcagaacatggggactaatggggatagtggggttggctgggagctctgggaaagcacaatgtggaaactcaagcatttcatgggctggaaattggggtcttctgggttgtcaggggcagcctcttagatctcttagcctctctagagtgtcagcctcctgagggcagggacttctgagcactgctggatccctggcacctagaacagtgccaggcacagaagaggtgctcaataaatgtgtgtttgatgaatgagtgagaagttgagatagaggagagtaattgtccgcaggagggggaggtctggcacctccacagaacttagcaagtcctgaggtgggactgactgtgcaggcactgttgtgcccatgtcggaacttcttaaatcctcacaacaaccccgcctctcttttaaagaaactcccctttgcttatcaccttcggggtccagcattgtttcatttcactgctgaaatgaacactttcccatgacctccagtagtggaggttgagggtttctcgcccaaattcccaaattcccgccaggctctcagcccactttggaactcaccctcccccccagtacacacgctttcgctggggttgccgcagttctgttccagcatggcatatggtccatgcctggccagtcagagcacagcactgcaccactctgacaaatatgattggttaaaagggggcccaggacctaagctggtccaatcacagtaaatcttagttagaactttgcctgggatagacatttgctctttttggctgaacttgaacttggaaggatgaggccctgaacttgaacttggaaggatgaaaccctgaacttgaacttgggaggatgaagccctaagtcgcctgcctgagaatgaaccagccagcagaaggcagagcccagagctaaacaagcctcgatgacatcatttgaataccttgatcaagctgcacctgaaatcacgatatctccaaacttgaatcaataaatttattttctgcttaagcaggttgagttgggttttctatttgcaatagcaaaagtcctgactggcaaggtttaaaagtttgaagactctcacaggtaagtgcagctcaggatcctgtgagtgcagcagaaagtcttaagaaatggcaggggctggttgaacccagattttccattggctgagcagatatccccagaggcgtagaaaattaaatttgttttatgttgttccaaaagaggagaactgaggccagaggagcacacttctgagacactcatttttgctgggtagaggaactctctggcaagcaggaccatcgatattagagcagctggcctcaggagggagtaagagccccatccctgaaggtacacaagttgtggcagcaaccatctggcctgcagtttccagaggggagtcaggcgtggggtgggactggagtgaacgggtagatgcttccacatgcggcagttggcactgacggcaggaacacgggggtggcttaatgggtcctggggctcccctctggccctcaggaaggcaggagcatgaggggcttgggatgcagcacctgcaaatttgcacgttcctggcctcaggaggcctccagtacagaaaagaccatcaacgaagctctgcagccatctgctaagaaacgccacagggaggggacagcatggccagccggggtgccatcaggctttgggtggggatcctggaggatcagacccatctaggtgggagcgctggggtgcaacctggaaggaagataagcagggaaagagaatttggggacatgcagaatccacagctctcgccttcctggctcacagctcattcccacctccaggtctttgctcaaggtttgactcccaccaggactgccaatgctgctctccccacctcaccagtcctctctgtccttctggtcccacacctccaggaggccttgtgggctgcctccaactcactgaccccaccatctgccccctggggatcatagctcaggctctcccacctccacccacatatgtgggtgcaggatctccctggctcgactgggctctcctagggccagggaccaaggcatcttttccatcacctcctgcaggaatgggcagagtggggctccgtgacacccactccctggcccgggggtggggggttaccaggcattcattcataccttgggccttgcctctggaagatgagctccagagagtgagactggcccaggcagatgacaagtaggctgcggaaactgaggcaacctccatacccaccttctttctgtcctggcctaaatgccactcacagtgaaccaaaggccactgctcagccagggcctgctgtgtatgggagttgggcactagagtgggggactcttacccctagaggaggctgcaggcgcgcttctgctgccgcgtgggctgagggcacagcacggcccggatggcctcgtcgaacacggttttcaggcctctctgggtgagagctgagcactccaggtatttcaccgagtctggttggggagatggacaggagagccaaggcctaagtggcggggggggttctgggccaacatgtctcctatgccatacaaccccttccacgccatacacccctcccacgccatacacccctcccacgccatacaccctcccgtgccatacacccctcccacgccatacacccctcccacgccatacaccctccctcccacgccatacacccctcccacgccatacactcctcccacgccatacacccctcccacgccatacaccctcccatgccatacacccctcccacgcctcccacgccatacacccctcccacgccatacacccctcccacgccatatacccctcccacgccatacaccctcccacgccatacacccctcccacgccatacaccctccctcccacgccatacacccctcccacgccatacactcctcccacgccatacacccctcccacgccatacaccctcccatgccatacacccctcccacgcctcccacgccatacacccctcccacgccatacacccctcccacgccatatacccctcccacgccatacaccctcccacgccatacacccctcccacgccatacacccctcccacaccatacactcctcccatgcctcccatgccatacaagccctcccacgccatacaccccctcccacgccatacatccctcccacgcctcccatgccatacacccctcccacgccatacaccccctcccacgccatacaccccttcccatgcctcccacgccatatacccctcccacgcctcccacaccatacacccctcccacgccatacacccctcctatgccatacaacccctcccaccccatacaccccctcccacgccatacacccctccatgccgtacaccccctcccaagccatacaactgaacaccaggctctgggggccgccatccagtcccagtggggtcacctggaggctgtgtcaccaggagcaaggagtttaacgtcaccgtgcctcagtttcctcatgtctgtaatagcgagcgtgaactcagtgagagactaaggcctccagggcaggtctgtgtctttcttggacacatagcccttagtccgtggaaggagggcgggaattttgatgcttttctgtgaaggaaagggctcaagcatcagtgaccaaatctctgggagcctcaccttctagaaaattgtcttgcccatccctccaggattctcccagggttgcaaataatccccaggaggcctgaagccctcagggccccctccccaggaacttcccaacatcatcagccccttccttagcaccgtccctgtcttacagacaaggaaactgaggctcctggagagtatgcgactcatccaaactcacacgctggatgtattccctcaacctgggcccagctgggggccttctgggaggagtggcattggagagctcctctgtcctgccatgggaggcccagccttctcccacatgaagacccctcagggctagagcccggggcacagatgaggagaaaggcaggcctagttcccacccccagggacggcgttccatgacattctgcaaagagtccgtgtgacttcccatgtccatttcaagctgcacagtttccctgaagtgaaaaaccacaaaaccccttctgccgagatgctatgcaggcctgggggccgatgtcagaaccaagaggaaggagaagggaggggaggggaactctgggccctccgccaaagcccgcttgcttctctgtggcaggatggaaggggatggacgctggtcaccacctaccctgtgccaggcactgagctgggtgcttccaacaacaccggggtgagttcccatttcacagaccaggaaacaggcccagagtggggaagccaaggcccgaaggcacagagctggggggagaagtcgggatggcaggaggggcagcccctggaacaggggagcccactgaggccaggtgctggggagaaaggaagggtggggcagggacgaggagcctgaggctcagagaggatgtcactcgctctgagtcacatgctgggcgtctcccctctacctggaggcatatacgcccaccagggatcatgggcagtggttgtcatggggcttggctggcaagagcagggtgccctgagctcagcccggagtctggtcaccacagccccctgtgttgaggaggtgtcactgggcacttggccactgtctccttataagggaccacatctgcgtccacttcccccacatccaccaactgccttttccctggcacccagccacccactcacccaggacaagggtcctgagctggggggccagggctcactttggctcggcctctcactgctctaggactttagtcagttccccctctccgggcctcagtctcccatctgtctaggactcattgccatgcgatggctcatcaagctgaggcagggggcaggggagctacagagagggcaaggagggtgagggggcggtgggggcagtggaggtgcagggaggacagatggccctcagctttgtggcttagggagccagtccacccctgtcagaatcctggctgggtggccttaagccagcaacatgtccccccgagcctgtttcctctctgtaaagtgaaggtgacaagagctcttcgtcatagctgctgtgagaatgaagtggctcccaggaagtgctcagtccacatcagctgtgattatcagctgggctcagggctgcccccaaaacttgtcatcccagggctggggagtccaggtgggcagaggcagttgctgcttccctcactatccctgccagtccccccaggactccccctaggcctaagctggtctgaggcacagttaaaatcactgcccctgccccagctccatgcagggtcagccaggaaagactggctagaggccaaggcaagaactctgagtcaccaccttatggaggagagagggcctttggggattgtccaggtcagcttatgtggagagggagactgaggcccagagaggggcagccactaacccaaggtcacacagccaatcagtatcagagccaggaccagaatccaggcctccagcaccctccacatgatcccaaagcatgtgctttacaagggagaggtcagtgacagccaggccacaggctggagagctgcaccctgaatagaaggagtccaggggcaggggttggaggggtgctggttggtcagaaagagaaggcagggatgaatccttgatatttaaaaggaaagacttgcaggctggggagctgtggccctaggacaggggaagggagccagggtgtgagccatagtctgaggcccccggggaagatggctgtgtcaccacgctagtcacagaaggagggaggtggtggctgcggtttctcttcctgtgaagagatgtgagtccccagggccctcccagttccggcagggggaggtggggcggggctggggcggtggggcgggaggaggtctagtggattcaatttgggggccaaaccctgggcctgcagagtcctgtggtgaggcagagggcacagctcatatgaccaaacccagctggtggttttgggcttttgggcaaggatccctgagctacagacacattgggacctaccagggacagggacaggaacagccagcaggcctgggtaccatgcatgaagccagacccatggtcatcgcctccctgatgcaggcagccctgagccactacaaagaagcaccccccagcagtgagccaataatttgctgtccttccttcaaatctggctgggccacctactagctgggtgaccttgagaagttactatatttctccagcccagtgatttggaggcaaagaggggtcgagctgagaaaccaaagggagtggggaaagggaggagagaaggtggtggaaggaaatgtgtcaccctttagatctaatgcagcgccacctcctccaggaagccttcccagaacacccaagtttgacttgccacttgtcctccaagcaaccacagcacccccactcaatctctgcttctgtctgctcaaagcacacctccttattttcagtatctattaatagatactactcatactactaggacgactactactaacacagagtgcttctcacacacaggtgctgccctggcagctccacctggaataagttactgaattcccccaaccaccccaggaggcaggagctatcactatcccatgcttttctgataaggaaacacaggcagagagaggctacgtgactcgcccaaggtcacacagcaagtgcacagcacagctgagttcaaactgcacagcctggccctgcagcccgtgtttacaatcacaccacgaggccaagtcagggcctcccctgcagccagatcgcccctctgagcccgaggcccataccaatctccttggccagtgccaggccctgcgggtaggtgatgggagccagcttcttctccttcagtttctcgatggtgtccttgtcgtcccgcaggtccagcttggtgcccaccaggatgatgggtgtgctggggcagtggtgccgcacttctgggaaccactgggcaggtgggtggggggacacaaggttgtatgggtcaagagggggcgcgaggctgtgcggggatcagagggagtgtgagggtgtagggagaggagaggcagcaagttgccagaagatcagaggtgggcacgacggtgaggagagagagacgtgaggtggcacagggaggggaggccacgacgttgtgcaggaaggagggggcgcatgattgtaggaaaggaggaggcgaggttttgtgcagacataagaagcaaacatgaggttatgtgacaatcggaggcggacatgaggttgtgtggggaggaggagaatgcagccatggaaagtgggggtatagctaactatcgcagcaccccccaccccaggtcctctgaatcttaccccctcaagtccctctgccagccctggttggcactggggaccctctctgtatgcgacctctgctgccccagggaccagcctagagtcaccagttcctccctctgtccctcagggttacctgccccagagcccccaaggcccaccctgtccagctcaccttggcgcggacgttctcataagaggctgggctgacgagggagaagcagatgaggaagacgtcctggggacagagcaagcgaggttgctagtgaggagggcccagaggtgtcccaccatggcagccaccgagaggtggagcttggggctccctgagggtggaacaccccagggaatgctggggacttaggatctgggcagagcagagatacccttctcgcctctaccacgaggctgctgtttgttaggacgctcactaaaggccagggcctctgcgaagtggttatcctcacatgtcactctgcagcaagcactgctggtagccccattcctcagacagggaaagtgaggcttccagaggttaaagagtttgccaacgtgcactctggtgaggggaggatctgggattctagagtccatactccaatccatatactatccaccatctgattaccggccttagccgcctccctgcataccctggaggaagggcgaggacccagcagccacctgcaggcatcctccacctctcccctcccccagcactcccagggctcaccatgctgggctgcctcctggggccctgtgcagaatccacctgccccaccactggaaacagggggtgccagagcccaggaggcaatggggtgggaagatgggcacattgaggaccgggaaccaatgcagggctgagggagtgcaagaggaagcccttctctgcctgggacatgcaaggcaggcagactccctgagctgggccttaaggggagaggtagggtttcccaggctgagctggctggaagggcatcccaagcagagggaacagagacagcaaaggtcaggactgcaaggcaggtgggagcagcacaccgtctgtggataggagagcggccggagacggtcgtagtcctcctgcccagcagtgtcccacagccccaggttcactggcttgctgtccaccatcacattggctgaatagttgtcaaacctgtggggagcaggcaaggcggaggtaaggtcaatctcaaaccccagaacctgggaattgtggtccagctccatgtcattcctcggaggctgagacctagagacagtctgcgactggcccaaagtcacacagcatttgcaattgggtttctttatttgtttcattactgattcattatattttttaaaaatgtaatacaagttaacaagaagaaaaaaagattgtctcttaatccttttcctacccgtacctgtcctttggaaaggtaattgaggctgtgtaacttttcctcccagtcttgatgagaataaacttacctctctccctatgctgccactcaatgtttgctttttgttgttttttgtttgtttgtttgttttttgaaatggaatcacgctctgtcgcccaggctggagtgcagtggcaccatctcggcccactgcaaactctgccccctgggttcaagtgattctcctgcctcggcctcccaagtagctgggattacaggcatgcaccaccacgcccagctaatttttgtatttttagtagaaacagggtttcaccatgttgaccaggctggtctcgaacccctgaacttaagtgatccgcccgcctcggcctctcaaagtgctaggattacaggcgtgagccactgcgcccagccgcaatattttgtcgaatgaatgttcatcccgtctcaggctgggtccccccagaagcaaaccctgagacaaggaggtgatgtgaggggtttattcgggaagtgactccaggatgctgcagaaggggagtggggaggaataaaggaggggacagcagctgacacagggcaggtggttgagttgtcatggctgtggactgctgctgctctcagtcctgctggggccacctgggagacagaacggaccgtgctcagggcgtccccagagaaggcaggaagctagggtgctgtcattcatctcccatcttccagggaaagagggctgcttccggggcctttcagcccaccccagagtgtgcgtgaaagctgttagtcactggccatgggaagggccacggcaaacggtagaaagacacatgctgccgaggagatggtgtgaggcactgaccttgactcccaatgtctcccgccagacccagagagccctgcagggccatcgaacgagcctccagatgcacttgctaggcacctactatgcatcgggtgcagagccagcgctggggccaccaaggagtacatgcctgatcctgcccccacagctggcggaaggccagacacggggtgaggggcctgacaaatatcagagacggggaagcccaacgaatgctgggagggccatcccagggctccaagctcggaataggggaggttttgcaagccagttcttgctacacacatccccgcgaggaaggtgctggctacccacgctgtggaagggaaaacttggctcagagagatgcagtgacttgcccaaggccacacagccagtgagtgacccaactaggtaagaaaccagaaaccagtgaccacgaccagtgctcactgccccaggccacagctgtgcctccgggaatgccctcaccgcctgcccctgagggttagggaatcactgtcacttttcccgctgtggtcccccacacaggccctgacctggtccactgagacctccggctcctctgacttctcctcctactcctcccctcgcacaccagccaagccgtttcccgggaaaggctcacactgcccacctccctgtgctggtccacacaaagcccctgcccagaatgtccttcccaccttagctgtccatatgttctcaccaacctggtctctggcccccacaccctccaggctgcccagccctccaagcctttgatcctgtctgtatctccctctggaatacgcttccagccccatttcactcccaacttctattcatgcttcaaaaccctgcccagacaagtcctcctctctggcggagcttcgtcgtcctctacctgtaaagagcccatggttccctctctcaggtgactactttgcctggaccacgagcaggcacttggtgagtctccaccccttcaagggctgtgggttctgtgtgggccaggccgatgcctgcttattctccacagtctcaggcctgtcacccagtgaatgcaggtggaagggaattaaaccacctcctccaggaagtcctcagagaacgctactcaatgttaggctgcagaagcgctaacacttcagagtaacacaaaagacacctctcctgagaggagtcccccacacccccaaaaagtgggcagcccagcctttttaatacactttgcctgtccagccctggacagaattcctggttacctctcagttcctcaaacggccctgttcccgcctgtctggaaagtgcctgcaaacagtggcccctgacttcccactctccttcctctctcccttctcttcctccccactgccaggctggctgacttttactcatccctccagcccctgctcaatgtcacctcctccaagaagcctttcctgacttccagccatgtcggggctaccaccccacctaaaccagcactccttggggaactcagcatcccaggtggcaggcactaagcctcatttgtttgccgctgcaccctggggccagcccgcggtctggtgcacagcaggtgctggcgtgcacctactctgggtaccacctacactgctgtgggatttcaggaagaaggcgctgtccagggagacacagtgaggcatgatgggaaaagccacacctgtgttgtttttccagttttgaccagaaacacacttttgggaaatgcttggacactctctcctctaatgtccagccacagtgctagtgccaagaagccccacaagattcacctgtctcctctgggtcatccctggaatctcagggccacggtgatggggaaagagctgggaccttgagaagcaacagccaccttctctgaggccaggcagggggctgagggtctttgtatgttaggtcttgaagtctcatgtgatccaagacaaaaggatcttaagttacccccattagacagatgaggaaactgaggcctgaagaggtcaaggacctttcttgttgggcgggaacacagagttccttgggaagccaggacatcctggctgtgtgaccctgggtgagtgacctaacttctctgagcctcaatctctttaatgtggaggggaaaatacctatttcttggagccattaggagaatccaaaaaaacagaggatgttcaagccaccccactgggagatgctgagaagctaagcagtctcattttccatgtccccaaatgcccctgccacagggcccctccccagaggaccagagggacaggtgcaggaatgtgtcaatggtgtgacacccctgagggtcccccttacttaagagacccacaggcagccaggaccagagaggaaccttatgcacagaccaccatgggcaaccctcaccccattttccggatgaagaaattgaggcttacagagaggaagggacttgcccaagatctcccagccagtgggtggcagagcaaggctagatcctgttacccaattcagaaaggcccacatggtaagcatcgctgctatttcatggctggaaatggagttggagagagcagagaccatgttttcatctagtgcctgtagaactctgaggcctggccctagaatggagtggaggaggggaatggggcaggtggaaggggccccagcacccaggtatcacctgaccaccaccgaagcccacccccacggaggaaggatggtgcattcaaggaacccagagaccacagggcacgcatggctagtgacttgggggtgagaaaggattgatgtcataggggcacggaccagtcaggtcttggttctcagggcaatggggaaccagcaaggggccaagccaggcagaggtgatgagatcagatttgcatttataaaaggtcccagctgggcacggtggctcacgcctgtaatcccagcactttgggaggctgaggcaggtggatcaccaggtcaagagatcgagaccatcctggccaacatggtgaaaccctgtctctaccaaaaatacaaaacttagctgggtgtggtggtgcatgcctgtagtcccagctacttgggaggctgaggcagcagaatcgcttgaacccgggaggcagaggttgcagtgagccgagatcgcaccactgcactccagcctggtgacacagcgagactccgtcaggaaggaaggaaggaagggaggaagggagggaggaagggagggagggaaggagggagggagggagggaccctcttggagaagtcttagggaggggccagaggggaacagagggggaaactggcacatcagccaggaggggaggcccttaccgtgctattggttgaaagatgaaggcagctggaggtgtcacggggcagggagaggtggagcaggagggaacagaatacccaacagaaggggtgcctgagctaaggcagaggcttgagccactggacatcatgaggcacccacacacacagcggcaggagcagggatggggctgccgagaggccaggcagaacctggtggggcctggcgcacacagctagggaggctgatgtcatcctgtccactggaatcccaggctggattcgccagtttaccgaagagaggatttcaaatgaaagtgaaaattaagtgccaaatgattcaacctcaattagcagcacacattcttccatgcagagctgagccctgccttcctccccggggtcggggaggcagtcatgacggagcaacaggaatgggctcagctctgttctagaaactggcgcgatggcagggagtgaggcagataagggccccgtcctcagggagcttccatccaagaggaggagtggcagcaaaggagcagcaagatgaagtcgggctgtcggggggcctatgaagacagccaagcagggtggtgggatggagagggcaggttggagacggggggctgctgtagacagggggtcaaggaggcgatgtttaagcagggaactgaatgacaggaagcagggagggttctgggtgtcataaaggggagtgaagaggttcgggggaggcagagatcatcaaggcagtctgtgtacttggagtgaagtgggtaaggggtgtggtaaatgaggctggggagacgggggctgttgttcacggtttgcgcattaagatgagttttaagtgtgaagggagccacaggagagatttaggccaggttaactttcagttgttttttgggaggctctttttattttattttattttttgagacagggtctcactttgttgcccaggctggagtgcagtagcacaatcacagctcaatgcagccgcaccctcctaggctcaagcgatcctcccacctcagtctcccgagtcgctgggactacaggcatgcaccaccatgcccggctaatttttgtattttttgtagagatggggtttctgctccatgttgcccaggctggtctcgaactcatgggctcaagcgatctgcctgcctcagcctcccaaagtgctgggattacaggcatgagccacggcgcccagcctaactttcagttttaaaagctcaccagggcttccgtcgagcttggttctaacgaggtgaggtgtaagggggcgcccctctatgccacaggcacacgagggcactgtcttcctgccatgtttctgtatccccaacacctagcacggggccatccacagagcagactcaggctccccatctgcgaaacgggggatttgatgcaaagaactcacagggccctgccggctccaatatagggtctatacaacagagcaggcggcaagagccaatcacggtgcagccccacgagtcctggcaactgattggctgctcaggaaggtgtcagttccgaaggttcaggtccatccctttgctgttaacccctcatggctggcagcatggggagccagctctcaggcttatctgatcttgtatctgcagcaggggcctccccaacccccagcaaacctaccatcctcagcccagaagctctctccaccttaatctcaggtgccagagatttggggctgcctgtttttcccaacccaccttctctccctcttccccctccaatgtcaagggcccagtgtgactattttaccctcccttcacaggggcacaggcattggcagtagcaggatcccgctctggggtctcgtctggggctgagaaactttgtgcctgaagccatatgagggtgtgaggcaggattcaccacagaacttgcaagacccagtgcaaaatggaagtacagggcccatgctcaaaaatgattaagaatttcaagatgtagacatcagagtattaaacaaggtgcaggacccttctgagcatggggccctgtgcaattggataggtggccacacgcatagagctggccctactgggataccttcacccaatccttcggagagacttgggaaggtagatctggtcgggcctatttctccagcttctgtgatgttgtccaggacaacaaagtccactaggggccaccagggatcagggacctccaggctgctgagagcacctggccataacctggcctcagcagcctcagccatccatctcaacgtacaagggaggtgcctggggaaggagcttgggacttccaagcctctacctcttatagaaaaggagattgaggctcagagaggggaagtgattggtccaaggtccttcagcaagtgggtccttcaactcagccaagatgcacaaaggcgggacaaggtctcaagccagcatccagagacccagggacagaggcagtgacaacacactgctggtgaccatggccttgagcaggagctgcctcacctaattctccctccctgctcaggtttgcagccagccctcccttggcacttagaggcacctgataaacgtttgatagttgatggtgagtgggcaggaatccttgttcccattttgtatataaggacaggaccagagaggggcactcaccagcatcaggaccgagctggggcaaaagcggctttctaggctctctgctagggtttccctgccctctcctggctgcctgccttcctctagcctgggccagggcatctaaggcagctgagcagagtgtcccggggagagacagcagcagagagagcccagcccacccaagtctggggttgggggttgggtagtgaggaatcctctggggtgggttggaagcatctcggctccaggctctcttctcccttctgcctgccctcctcttcctaggagagcctgatccctgcccctgaaaggggggttcattaagatcaagaaatgagggcccccgcgaggttctgcatggaccttggctctgaagctggacaggaccgtgtaagcctgggaggcaagcctcttagtggctgtgaggctcagcttccccatgggtgtcctgtgcatgctaatagccatctcccagggggatcaaatgagatcacacatgtgtgacatcttgcgcaggggccagcatgtggcaggcctttgctagatggtggctatgatcgatcttcctgtggtccttcccacgatgtccaagtcaggtcaactcaaaacacatgtgttgtgtgtaaggtaatgcatgtgtcataccatgtagaagacactgtgctgagataatgggagacccacaaagagctggccatggctccctgccctccacaggctcatagtcatgggagagatcagataaagtcactctggggagtggagaccccttcgtggtagatcagaaaggcttcccggaggagggggcactggagctgcgcctggaggctttagacaggtggatgtggggagaaaaagcactatggggagagagaacagcttgagcaaaggccctggggtagaaatgtgcagggagcttgtggcgaacagtagggtccggaggaggcagagtgtgaagcaaagtaatgggtaataaggccaggtgggaggttgagtgaaggccatcaggagccttgagtgccatgctagggagtcggggaaatgtcctaggagtgatggggacccctgagggctggccagggaggggctggtgcctccccagtcatccttccctcctgagtctgacaccaacacgctccctccacgtccgatgacagccctgcctccgcatcctgcaatagagcgcagggcctcccaggcctgcagacagctctgttccacccctcagcatgccttgtccccaggtgtccctgttccttggagtcaggctctctggatcacctcctccagcagcctgcttccgcagaagctcctctcccagctcctgctcttgcctgagccagccttctcctccacgtccctttgcttggaggcccagcctaaaggccacccctcctcccttctaccccttcctccataccccatcccgggttctgggagcccccagcacctctcagcgccagtgctgccttcttggctggactgtcaggcagctccactgggctggaggctgtgggtgcccacacagggtctggcccacaggaagtgcctgaaaggggggtcgacttggtgacggtctctcccctcctcccaccaccccacatatccccaggaactcacacggtggggatgtactctccgggaaaggcgttggtggtgtagctgatgagaaggcaggtcttgcccacggccctgaaagacaggaagtgcaagagggcggcggtcatgggctctgccggagacgtggggaggtttctgcctggtcctctgcaaagacctcagcatccacccagcctagccctctgggcctccgtctccccatgtgagatgccccctgtctgtgttctcacacccgagagcctgcaagtcatgtggatgtttgttaaagtggagacttcagggtccagccccagagattctgatccacaggtgtgcgcagagctggcaatccgcttttcccacaggcttctccaggggccagtgatgtgggacagagggtgcccagcagacccaggcaatgccgaggggcccccgacgcctgacctgggcttcaaatcccagctgtaccacctaccagtggtatgatcttggacaagtcacttaacctgcctctgcctcagtttctccatctagaaaatagagatgagcccatcctcataggagtgtgctgaggagtaaatccaacgaggcctatcaaagcactgagcacagggcctgatgcatggcagcagccgatggctgctagggaagacctgaccctgctcttccctctcacctcccccgtggagcagagcagttaccaggtcagggtttgagtcagagtggtctgggttcaaatcctgtgaggctttgggcaaattacttagcttccctgaactttcattttcccacctgtaaaatggacctattaggtttggtgagaggataaatagagaaggctagattaaccccagagctggtacataggaaggaagtgataacgcgcgcctcctccaccctcagcatgcgaggctgggagcgggtgcaggtagctcagccgaagcccagaggccaagggacagctctgggccttcccctgccctgcgtggttttgtcacttcctgctcagagaagacagctcatcctctcctcctaccatcgccctcccctgggcctgccaccgaggtaattttgaatgactggaacgttaacccttgacttccgcccgcccctcctccgatcagatacaaagcagaagtgaacagggctggggcaggcgagggcagataaggagccatgcatcagaatcagctgaggctggtggacaaatgggcccgcccccacctagatgggtcacagccaaagtcggggccacagggcccaggccaggagagctgagtctctcaaagccttgggctgctcctctgtagaatgggaaggctggacaggaggcccccttccagctagaacatgctccagggtgagcctgtaggctggaccctaagatgtggctgctggcaggcatgacagattgacaaattggacctgtccttttattttgtgtttttttaagagacagcgtcttgctctgtcacccaggctgactgcagtggcaccattatagctcactgcagcctcaaactcccgggctcaggcgattctcccacctcagcctccccagtagctgggactgcaggcgcatatgccaccactcctggcttaaaaaaatttttttatagacataggttctcgctatgatgcttaggctggtctcaagctcctggcctcaagcaatcctcccatcttggcctctcaaaatgctaggactacaggcatgagccactgcacctggcctggacctgtcattttacagatgaggaaactgaggcccccaggggacaagacagcctgaagtcactgggatctgacaactgagaagggtctcagcccagcctgcccctcccctgccgaccccacaatcaccctcccatcctttagcctcctccttccctctctgtctctcaatgtccccttgcctcttctgctcctcacccacatcccccacacatcctccccaacccggtaggctgaggggaggggagagaaagtggagggggtgctagaaggcacatactacaagcaagacagccactcagcttatctcaagcgaccccacagcatccccagggcataggcctcctcccagatgaataagctgaggttcagagaggtgctgtgacttgcccaaggccacacagcggcaccaagccagtgacgacagcccaggtcagcctggggacaaaggctgaatttcaggtttcccacttccctcctgcatccacagagtaaagactgaggcttgcctccgtgggagacctgcccccagcttttggggtgcaggtgaggagccctgggcactctcacccatagtcctgcaccctccaccgagatggcttctggggtggggtggggctgaagagggtgaagctcccctcagcccacccccgggtgctccctgtgggccctcggagaaggaagcgtcccctccaagctgccttccagggacgcctagttctgcagggccaggggcttccccaggggcaccagggcggaaggatctcagggcatcccagttgggggctgtgaggaagtccagccaggtacctacccatctcccaccaccacacacttgatggcctgcatcgtgtccggagcctggagagtgtcggtggtgacagctcagggccaggcgcgtttctgcgggcgcaaggggtgtggaggctggtgaggcgcctgctgaggagcagcggtggtggggcaggaggaaacggaaggggaacttactcaagctgctctccccacggtcgtttgcagggggcggagcatgcggtctggcagagcagctggtgggaggggcgctcaggtgctgggctgagccctggccatccccacaggccccctgcgtggaggctccagcaggagacctgggggccctctgtgctgggaggctcacttcctgtccacggggcgggcccagaggctgttctccaagaacttgagggttccaagaattcagtgcacttcaattctaagcagagcatttaatgagtgcctgctgtgtgccaggcacagtaccaggtgctggtgatcccaggatgcaagagacagctggtccctggagtttataccctttgcagagagggaggcatgacttcatcatgggagatcataacagagacaggaagtgattgaggcaacgggggaatctacagagaggacctcagggttaccgagatggagagctgggggcctgcaagctagcattggagctggctcttgaaacgtgcgccctaaagagggaactccaggtggggggagattgcttgagccaggacccagaggctcccccaggcaagggcctgtgtgggagtccctgggtgggaggatgtggggcgatgaggcaggaagggaaggtggggtccgctgatggagaagggcacattgaggggaagtggcgggcagtgccccacaggagccaagcctattctgaggccgccctgggggaccaggcaccctggagctagaactgtggcccatttccctgatgcgaaaactgagggtctgagaagtcatttgaccacctagcctgaaaccagccctaggctcaggtgactccaagctcttctccaagctgcagctattggctccggctgctgtttgaagggacaaaacctgagttctgcagcttgcagggcgctcccttcgccacgagggctctccacgtggactcgggtgaatattcgaccaccccagttggcaccaagttcactgttcattgctatcactccccacccacacacctttccagctccggggggaagggacggaggggcggggagaggaagagccactggtcacccaccctggactcgtcactcgggacaagccaggaactccaaaggagggtgcagagggccagggcctgctggctggcagagcgcaggattcccaccaggcacccggaggctgaaccttttcagagcaattcacacaagttactgggttcacaacattgacttttacagaaagggaaatgcaacttcctcaagcgctgggcaagtcaactgttaaagctaccagcaaaccggtgtctttcctctgcactttgcatacgctgtgctgagactgtgggtcagagaggccaggtgtgccccgtgaccaccctggggcttcctccctcacaggccacctgaggactttgttctggatacttctctatgcccctttctttttccatccactgctagtccacggggcaacctctgtgttaatttaaataataataataatgtattaaatgcagtgcggtaccccagattagaacctggaacagaaaaagaacatttgtggagcttcagtaagacagaaagagtaagttctggtgtcctgttacacagtagggtgactacagcaaatctcaatctcgtgcatatttcaagacagctggaagggaaggtttcaaatgtcgcaacaaagaaatgataaatattaaaagtgatggatgtgggaattacctggatttgattgatcattatacggtgtatacatgcattggaacatcacattgtaccccataaatatgtacgattattatgtgtcaattacaaattaaaaatttttaatacattttttaaaagaattcatttctagttcttgaagggggaaaaagaaacaagtgtttcatctataaatgcagcttcttgaagcaatttaaacgattaaattagctttaaaaaaaaaagaacatcaggccgggtgtggtggctcacgcctgtaataccagcactttgggaggccgaggctggtggatcgcctgaggtcaggagtttgagaccagcctggccaatatggtgaaaccccgtcactactagaaatacaaaaaattaacgaggcgtggtggcgggcacctgtaatcccagctactcaagatgctgaggcagagaattgcttgaacccgggaggcagaggttgcagtgagccgagatcgcaccattgcactccagcctgggcaacaagagtgaaactccgtctcaaaaaaataaaataaaataaaataaaataaaaataagaacatcagtggaaaaagtagtaaaatccaaatcaagtctgaaatttttgatagtattgttaagaatagtaatttcttagttttgacaaatataccgtggttacacaaatgatgttagcatagagagaaactgggtgaaaatgtatgtgaacactcctgctatctttgcacctttcctgtacatctaaaattcttccagaataaaacatttttttgtttaaaaaagggaagagaaaagaataatgcgcttctttaggaatgcacagccaatgggtgcagccacctgacttggaaagcagtgtagatactgagttttatccttcgttcacctactagagcagagattgttgttttttgttttgttttgtttgtttgtttgtttgtttgttttgagacagagtctcgctctgtcgccggtctggagtgcagtggcgtgatctcggctcactgcaacctccgcctcccgagttcaagcaattctcctgcctcaacctcccgagtagctgggactacaggcgcgtgccaccgcacccagctaatttttttgtatttttagtagagacagagtttcaccatgttggccagaatggtcttgatctcctgacctcgtgatccacccgccttggcctcccaaagtgctgggattacaggcatgagccaccgcgcccggccttttttttttttttttttttttttttgcagtacacaacccactcaactgtacatggccatgacggtcctaaaattgcaactgccctccctcccaagaaagccacttctccagggcagcccaagcaaaaattctccttagcttaagccattgattctctccttcattctgcatgcatcaatgatacaccacctgaatacccagctctgggcttggtactgtagtgaatacaaaacatggaagaacagaaagctatccctgaagcactctaacccacaccgagaatgacacaggagccctggaaccactctctgggaatgtcccccatctgcaggtggtcctgggattgtgtggacaggccagggttggcaggatggccagatggaggagtgaagccacttggacgacagcagtcaggcccaagtctacgtgaccaagtccatgatgcagcggcactgacctctgctccagccctcctcgccttttagttctttttttaaaagtatccatatgcactttcggagccgaggcgggcagatcacgcggtcaagagatggagaccgttctggtcaacgtggtgaaaccctgtctctactaaaaatacaaaaattagctgggcatggtggcgtacacctatagtcccagctactcaggaggctgaggcaggagaatggcttgaacccgggaggcagaggttgcagtgagctgagatcgcaccactgcactccagcctggcgaccgagcgagactccgtctcaaaaaaaaaaaagtatctatgtggaagtataatttgaatacaataagtgatccatttaaagcatataattccattcattttgacagatatatgcacccatggaacctcccaagatacagaacatcacagaacacttccatcactttgaaaagcttccttgcacccccctgcagcccacctctccctgtttctccctccccacgcccccagccaccgcccagctcacacacacaagctccgatctgctttttgcctctgtagattactttgcgttttctaggatttcacataaacggcatcacacggtgtggcatctcatccaaggccctttcacacagcatattttcgagattcatcttgttgttacatgtgtcatggtgtgtctgtcccttttattagtgagtagtgtcccaccgcagggatgtgtcacatttggttattcatttagtcccatcctcttttgactacactttgcaaactcactgaatcacagaaccacgaggcctctgggcatgcttagaaggggcctaaggccatctgtattcaacccacccttgtgccattgatagacaatgcttggctcactgcccatgatgcagctgcccagtccctgcttacataccttcaatgacagggagctcattcccttaaggggcagtctctttcactcctggctagcctggcctgttagaaaacccttcctcattttcagcccaaatccttcccttggattgtcctcatagaggtgctacctcttgttctggggccactcagggtcagtcagctccctcctcctcaccacaggccttcgaatttgggaggcacagtcccacccagcagtgtgctgggaaatgttcaacttagagttccagtttagttatttttctggtaaatattccagtatatgaatgtattgaaatgttatttatccaattcatgcagataatgacattaaatacatatcacacaaaaactaaaaacagtcaatatatcgccacaccctaaattctgtccaaagtgtgtaaagacctactcatatttatttcgtttttccttttttgagacagggtctcactctgttgcccaggctggagtgcaatcatggctcactgcagcctacatctcccgggccaggatttgtaagtggcttgcaatgtttgcactacaaacgattctgctgtgaacatccatgtgctcctgggctggtgtgtgaggtttagcatacacacacatatcttgcacttcaacggacagtgctacgcccatctccaggggcctcctcgtctactcccagcccatgcttggcctgtaagacttcatacttttgccagctagatgggtgtgaattggcatctcactgaggttttaatttatattaactgattcccagtggtattaagcatcattgtaagtgattactggaccttgtgtttcctgttccataaattgctttttcttcacttttctccatttctctattggagcatttatctattttattttatttattttattttattattttattttttgagatggagtttcactcttgttgcccaggctggagtgcaatgtcgtgatctcggctcactgcaacctccgcctcccaggttcaagcgattcttctgcctcagcctcttgagtagcgatgattaaagatacacgccaccatgcccggctaatttttgtatttttagtagagatggggtttcaccatgttggccaggctggtctcaaactcctgacctcaggtgatccacccacttctgcctcccaggtagtgctgggattacaggcgtgagccactgtgccaggcccagtatttatccttctcttacatttatttggagaagctctttgcatattctgattttcatttgaattgctagaggcatttcatactttcttccagtccgtgggatgtcttttaatatgttgtgacatttaatagacacaatttttatctgcatgtagtcaaatttccactttctctcctaattgaggtaggaggcagggtttgactcaagaccagactgaggactagcagaaatggggacgaggcgaaagcacctcttcatgagacatgcccagcagcgccatgtcagtttaccattgccatggcaacacccggacgttaccacccctttccatagcaacagcccggaaactaccaccctttttctagaaagttctaaataccccaccccttaatttgcatgtgactaaaagtgggtataaatatgacggtggaactgcccctgagctgctgctctcagtacactgcccgtcaggtagccctactctgcaggggcactcgcgcagctgtaacactgccacctccataaagctgttttcttccaccgtcagctcagcacggaattccttcctgagagaacccaagaaccttccaaagctaagccccaatttggaggctcacctgccctgcatcataatgacttgtgttttttggagtgaatcttacttaaaaattcctttccttcccccaatttcatgaagacgaatatcctcattttcttttaaagttttgcttttcataaacaggtcttgtcaggtgcagtggctcatgcctgcaatcccagcactttgggagatgaaggcacatagatcacttgagcccaggagtttgaaaccatcttgggtaatatggtgaaaccccatctctacaaaaaatacaaaaattagccagatgtgttggtgcatgcctgtagtcctagctactcaggaggctaaggtgggcaggtcgcttgagcctgggaggtcgaggctgcagtgagccatgatcataccactgtactccagcctgggcaacagagtgagaccctgtctcaagaaagaaaaaagaaaataaatatgagtaggtctttacacacttcagacggaatttagggtgtggtgagattattgactgtttttagtttttgtgtgatatgtatttttttattattgtattttattttatttttggagactgagtctcactctgtcacccaggctggagtgcagtggcatgatcccagctcactgcaacctctgcctacggggctcaagcggttctcctgcctcagcctcccaagtagctgggattacaggcacgcaccaccacacccagctaattttgtatatttagtagagatggggcttcaccatgttagccaggctgatctcgaactcccaacctctggtgatctgcccgcctcggcctcccagagtgctgggattacaggcgtgagccaccgcacctggcctgtgtgatatgtatttaacatcattatctccatgactgattgttccagaaccatttattgagtagctctgcctgctttttgcccagtaagctgtggtcaagccatctcgcatctcacagttccactgctataaagaaatatctgggaatgggtaatttactaagaaaaagaggttgaactggctcacagtatcacaggccgcacaggaagcatggtggcatctgcttctgggggggcctcgtggtggaaggcaaagtggaaacagacatcttccatggcaagaacaggaccaagggggtgagaggtgccacacactttcaaacaaccagatctcacaaaaactcactcactatacagtacccaagaaggatggtgctaaaccattcatgcaaactccgcccccatgatccaatcacctcccaccaggccctacttccactgttggggattacaatttgacatgagatttagatggggacacagatccaaatcatatcacatgtcaagagtctataagtgcatgagtcttttcctagcctctccatctattggactcttggtccaccctcaagccggtaaaacactgcctcaattactgcagttcttttttttttttttttttgagacggagtttcactcctgttgcccagactggagtgcgacggcaccatctcggctcactgcatcctccacctcccaggttcaagtgattctcctgcctcagcatccaaatagctgagattacaggcgcctgccaccacatgtagctaattttgtatttttagtagagacagggtttcacatgttggccaagctggtcttgaactcctgacctcaggtgatctgcccgccttgacctcccaaagtgctggtatgacttacaggcgtgagccactgcacccagccaactactgaagttctatatcagatctttatacccagcagagcaaatcatccactcttgaatgttttcaaaattgttatcgttaccactgacactttgctctttcatataaagttcataataagcttgtcaagttccaagaaaaactgtgtgaggattctgattagaattgtattcaatttctagaggaacttggggagaagtgacatctttatatattgagtcttcctgtccattaacatggtatattgcttctttatatctttcaattaagttttataatttccccccggaaaggtcatgcacattttttgaaagattcattccttgataccttattactttcagtgccattataactaatattttttaaattgaattttctatttgttgcccatacgtagggaaaatgtcacattttgtatattgaacttatatagaaacctggatggaaattctcattctaatttatgtaaagattttgctcctaacaagtctacagctgtctttatagacagtcttatcatttatgaaaagtgacagttttatttcttccttcccaatttttataacgttaattccttggcttgtctagatcttttattacagggctgaagggaatcagtgctggcaggcaaccttgtcttatttctgattttaaagagactgtttctaatgtttcaccattgaacctgatgtctactgcaggcttttggtggatattattgtcactgaaagaagtttccctactattcttagaaacggcagttttgttttatcattattaagcgtttaatttgattgaatgtctttttctgtacccatggaaatgttgtgaattatattaatacattttctgatgtccaattctccttgcattcccagataagtctaatttagttaatatggggactattgctgagtatccctaagcaaccgttctctgcttctttttaataacagagatcccagcattggggctagccacacattcacccagctaaagacatttctcagtctcccttgcagcagagtgggccctatgatcatgtctgggggaaaaaggtgcaaatggaagtgatgtcagcaacttctgcatcatctccttggaagctaaaccatttatcctgtacagcattttcccctctccccacggagtaggaaataaaaacgccagaacaatcctggaaccatgtgggggcaacatagagccagaccactcagctcgagacctgagagagaaatacacttttgcttctttaagccactgcgttttcagatctttttgttacagcagcttcagtcacaccctcactcagtcagtcatgatgcatcgccttttgtgtattgctggcttgaaattgccaatatttacaggtagggtggggagatcggccggtcattttccttatattgtctttgtctttttttgttgttgttgttatcaaggttatactagtttcattatgagagttggtaatattatgttttgtttttttttttgagatggagtcttgctttgtcacccaggtggagtgcagtggcacgatctcggctcactgcaacctccacctcccaggttcacaccattctccattctcctgccccagtctcccgagttgctgggattacaggcgcccaccaccacgcctggctaattttttgtatttttagtagagacagggtttcaccgtgttagccaggatggtctcgatctcctgacctcgtgatctgcccgcctcggcctcccaaagtgctgggattacaggcgtgagccaccgcgcccagccagtttggataatattacattatctctcccttaaatattttataaaatttataaagccatctgtatctggacctggtttcagaattatgggggagagggggaagaggggtagattttaaactactaattcaatttctttaaggggtataggactatttggaattccttttttttttttttttttttgagacagagtcttactctgtcacctaggctggagtgcagtggtgtgatctcagctctctgccacctccacctcctgggttccagtgattctcatgcctcagcctcgcaagtagctgggac

SEQ ID NO: 468 - DNA, 45191 bp, Homo sapiens
aaggtcaggagttcaagaccagcctggtcaacatggtgaaacaccatctctactaaaaataccagaaattagctgggcatggtggcacgtgcctgtaatcctagctactggggaggctgagtcaggagaatcacttgaacccgggaggcggaggttgcagtgagccaagatcacgccactacactccagcctgggcaacagagcaagactccatctcgaggaaaaaaaaaaatgatattgccccattgcactccagactgacaacagagcaagaccctgtctcagaaaacgaagaggaggaggaaaaaaaaagtactaattatctgaaattccaatttaaccaggcatccagtgttttatctggtaaccctcattcttacacacacacacacacacacacacacacaaaggcgggatagttgtcattcccactgtaaacataaggaaactgggcagaggccaagcaaccttgtgtagctcacatagcaagaagtgggtgaacccagctcatgtcttgactctgagctcagagagtgacaacttgtcaccagcgcccccatagccaccaccctttgtccaccccaggctccctctgcaccccaacgcaagctccggccgcttctctgtccccctcctcctgccgcatcacagcccacctcagcctctttgtaggtttccatgcgacgctgtaccatggctgggagtcttccaggcgccgtgctgagcgccttctgtgcatggactccaagtcgccataatcgtacgggttacccaccattatcagtcccctcttatacatcaggctagtgagacagtatcttatccacagtcctacagctggcaggagtagattcaaaccctagcagcaccaattagtggtaaagagtgtggacttgggaacttacaggagtagagagcacagtggtggttaccggggcggtggggtaaggtttggggagatgttggtcagaggaggacagtttcagttggacaagaggagtatgtcttggagatctactgcacatcatggtgactgtagttaataacaacatattgtacacttgcatatcaccgatagtagattttaaatgttctcaccggccgggcgcgctggctcacacctgtaatcccattttgggaggccaaggtgggcggatcacctgaagtcaggagttcgagagcagcctgaccaacatggtgaaaccctgtctctactaaaaatacaaaaattagcggggcgtagtggcaggagcctgtaatcccagctacttgggaggctgaggcaggagaatcgcttgaacctgggaggtggaggttgcagtgagccaacgtcatgccactgcgctccagtctgggcaacagagtgagactccatgtcaaaaaataaaaataaataaaaataaatgagcgtggaatactactcagccattaaaaggagtgaaataatgtcttttggccaggcacagtggctcacatctgtaatgccagcactctgggaggccgaggtgggtggatcacgaggtcaagagatcaagaccatcctgcccaacatggtgaaaccccatctctactaaaaatacaaaaattagccgggcatggtggcgggtgcctgtagtcccagctactcgggaggctgaggcaggagaatcacttaaacccgggaggtggagtttgcagtaagccgagatcacaccactgcactccagccttggtgagagagcgagattccgtctttaaaaaaaaaaaaaaaaagtcttttgcagcaacttggatggagctggaaggcattattctaagtaaagtaatacaggagtggaaaacaaaaatctgtatattctcacttataagtgagagctaagctgtgggtatgcaaaggcatgcagagtgatgtaatggacttcagagactcagaagggaagggcagaagtggggcagggatgaaaaactacacattaggtacaaggtacactagtcaggtgacaggtgcactaaaatctcagaattcaccagaatataattcatccatgtaaccaagaaccacttgtatcccaaaagctactgaagcaacaagccagatgcagtaacctgtacaggccacacctgtaaccccaacactttgggaggccgaggtgggtggatcgcttgagcccaggagttcaagaccagcctgggcaacatagcggacccccgtaactaaaaaaattacaaaaacaagccaggcatgatggtgtacaactgtagttccagatactcaggaggctgatggggaggcactggttgagcctgggaggttgaggctgcagtgagccatgatcatgccactgccctcctgcctgggtgacagaagtgaggccctatctcaaataaaattaaataaataaaagttaaaacaggctgggtgcggtggctcacgcctgtaatcccagcactttgggaggccgaggcgggtggaacctgaagtaaggagcttgagaccagcctggccaacatggtgaaaccccgcccctactaaaaatacaataattagccagacctggtggcagatgcctgtaatcccaactattcgggaggctgaggcaggagaatcacttggacccgggaggcagagtttgcagtgagctgagatcatgccattgcattccagcctgagcgaccgactgagcgagactccatctcaaaaaacaaacaaaaagaaaaaaagaatacatccatggatggataatgaatgagaggttgtttatattcacagttaaccctctcatctccagtaatgcaaccatcttcttcctgcttagccttttggagatgctgtccctttagtggtcaaattctgaagaaatcaggaaataatgcattcgacatgcccagcacaagtgaagatcaggcagcagaaatgcattcgacctgccacccatccatcaggagactatttactccactactgtaggggatactgacaaattaaatccatacctagtccagatatcaattccacaatttttttttttttttttttgagacggagtttcgctcttgttgcccaggccagagtgcaatggtgtgatcttggctcaccgcaacctccacctcccaggttcaagcgattctcctgccttagcctccagagtagctgggattacaggcatgtgccaccacacccggctaattttgtatttttagtagagatggggtttctccatgttggtcaggctggtctcaaactcccgacctcagatggcccacccgcctcggcctcccaaagtgtgtaagccatggcactcagcctttttttttttttttttttttttttttgagatggaggctctctctgttgcccaggctggagtgcaatgcctgacctcagctcactgcaacttctgcctcccagtttcaagcaattctcccacctcagcctcccacgtagctgggattacaagcacccgccatcacgcccggctaatttttgtagagatggggtttcaccatgttgaccaggctggtcttgaactcctgacctcaggtgatccacccacctcggcctcccaaggttgagattacaggcgtgagccactgtgcctggcccacattttttaaaaaaggggcaactgcagtgtagtagaacaaagttgtgaccaatgctaggatactctgttcatttcctgacccagccatgaatacactggaataactcatgcaaaatgccagctcgctggccccccgtttccccacccaacaaatgaaggggctcttacaggttcctttttgtcctgaaattcatcaccaatgcaaatttcttaaaaatcctttgtctggcagtccatgcctgtccttcagcatttcccagatctgaccctcaggactcaccaagacagaagagggcggtcggggatggagacatggttcctcagccctgtcctgagctctgtggccagggagggaagtggtgggagcctggggcacaggctcaggatgtgatgaggatgaagaatgctctcctcccttcctccaccagccccggcctttcctaattgagactcatcgagccgtagccggctcctcagtacagtgacttgcacacaagctccaaggagccgcgcttatctcctctggccagcctggcgttgcaccgtttgtccgcctgctggggcctggtctgtgttcccgtgctcccataaactccctgatgtcactaggaaaatacgcatcaaaaccacagtgagatatgacttcacaccttctggaatggctgtattttttttttttcttttgagacaaagtctcgttctttttgcccaggttggagtgcagtggcgccatctcggcccactacaacctccacctcccaggttcaagcgattctcctgcctcagcctcccaagtggctgggattataggtatgtaccacaccaggctaatttttgtatttttagtagagatggggtttcactgtgttggccaggctggtcttgaactcctgacctcagttgatccacctgcctcggtctcccaaagtgctgggattacaggcatgagccactgcacccgaccggctataattttttttaatggaaaacagcagatattggtgagtatgcagagaaattgaactgcgcgtgcattgctggcagggacgtaacatggcgcccctgctgtggaaaacagttccagcagctcctccagaagttaaacgtgggattgccataaaatccagcaattccacttcggggtacacacctaaaagaactgaaaacagggtctctaacatatttgtacacagtgttcatagcagctttattcacaatagccaaaaggtgaaaccacccacatgtccatcaacaacaatggataaacaacatgtggtatatacacacaaggtaatatcaaccagccttaactaaaagaataaaaatcagccaggcacagtggctcacgcctgtaatcccagcactttgggaggccgaggcgggcggatcacctgaggtcaggagtccgagaccagcctggttaacatggtgaaaccccatctctactaaaaatacaaaaattagctgggcgttaaattagccgggcatggtggcaggtgcctgtaatcccagctacttgggagacggaggcatgagaatcgcttgaacctgggaggcagagattgcggtaagccgagatcgcaccactgcactccagcctgggcggcagagtgagactgtctcaaaaataaaaataaggccgggcgtggtggcccatgcctgtaatcctagtactttaggaggctgaggcaggcagattgcctgagctcagcagttcaagaccagcctgggcaacacagtaaaacccccaaaaaatacaaaaaaaaaatagccgggcatggcggcaggcacctgtagtcccagctactccggaggctgagacaggagaatggcttgaacccgggacgcggaagttgcggtgagccgagatcgcgccattgcactccagcctgggtgacagagcgagattctgtctccaaaaaataaaaaatattataaaagaataaattcagatacatgctacaacgtgatggaccttgaagacattatgctaaaggaaatattccggacttgacagataaatactgcattgtgccgcttatctgaggtatcgagaggagtcaaattcatagagacagggattagaatggtggttgccaaggcctgggaaaagtggggagttactatttaatagggagcgcttaggttgaagatgatgacaaagtctgggggatccatagtggtgatggttacacaacactgtaaatgtatttatatttaatgccattgactgttttttgttttttggttttttgagacggagtctcactctgtcgccgaggctggagtgcagtggcgcgatcttggctcaccgcaacctccgcctcccaggttcaagcgattctcctgcctcagcctcctgagtagctgggactacaggtgcgtgccaccatgcctagttgattttttgtatttttagtagagacggggtttcaccgtgttagccaggatggtctcgatctcctgaccttgtgatttggcctcccaaagtgctgggaatacaggcatgagccaccgcgcccggccagtgccgttgacttgtatgtgcacttacaggtggttaaaatgagaactatcagggtgttgatatctaaaaacctccctgccatcatcttccctacatctctcattcagtgaccatggttgaatgcctgccacctttcaaatattatgtcaggcactcagtattggcagttttatccattataaatgctttaagctgcatagaattttaaacgtgttaataaaagtagttataaatctttaatacataagctggctttaaaattattggtaaaataagattagaaatgtcttaagaattgttggcgtttttgtttgcacttattgaacgagtggtttcatgcttatccctgcagaatactatgagatttgtcataagggttataaaactataaacccggctgggcgtggtggctcacgcctgtaatcccaacactctgggaggccgaggcaggcagatcacctgaggtcgggagtttgagaccagcctgaccaacatggagaaacgccatctctactaaaaatacaaaattagctgggtgtggtggcgcatgcctgtaatcccagatactcaggaggctgaggcaggagaatcgcttgaacccgggaggcagaagttgcagtgagccgagattgcgccactgcactccagcctgggcaacaagagtgaaactccatctaaaataaataaaaataaaacatttgttttttgtagagttggggtttcactatgttgcccaggctggtcttgaactcctcctgggctcaagcaatccaccgacctcagcctcccaaagtgctgggattacaagtgtgagccactgtgcctggccctattgggtccttttaaaagatacataaaaaatcaaatgcaacagtgaagtcaatcacccgatggcagaaattggggtgctcctggcatgtggtcggtcgaagccaaggacactgctcagcattctgcagtgcacaggacggccccgcccaggcggagaatgatccggtgacacatataggtgggaaggatgcacgaatgatggcgtttaggaagaatattatcacttctttcccgtaagagcaacttagagcaagaaaatggtattattcttagggccttctctcttatggaggctccaagccagggttgccatggcagaagatgctgggcttgctttttccttgagagaactgtactcaagatgatgtaactgtcaccccgggtgccacttgggtgctttggagaagcgctcagacgcgacacgccgtgacgactccgcggcaggcagccggacctgtcctctggcgtgcggttcacgggctgtgtttatccccctggttccttcacagccaccttgggaaatacgttgcctctgaatcacgccaggcaggctctcactgtgtgtgctgcggggctggaaatcagggtgacactccgctaccgaacagcctgactaggaagccagaaagacgctgccggctttagtttgtcctttgactttccttgatatgaatgaagatagagcacttccacactgcacaacaggaaaagcccagaacgcttcctggagatagcgagggggtgatgcagcggacagctatggctgatgaccccctcacctctgactccccctccctccctgctttctgaacgcacatccatcaccaaccataggttcctgtttggggtttgctggctggaaaaaaaaaaaaaaaaaaaaggaaagctggctttctagtaaaaaccacttcctttgctcatttatcaaactcaaacgctaggagggccacctaacatcctccgtcccacgcaatggggtgtttctggagcactccggtttatcagggaccctgtcagttgccatcgcacatgtatatggggccagcccctgtgccaccgaagaggggggatattgaaaacatgttacagccaggagcggtgcccccttggttcaagcagttcttctgcctcagcctccctaatagctgggattacaggcgtgcaccatcacgcctggccactgttatgtagtttttaccacaatttaaaaaaggaaagagtgcctgggtgagtcctacgcacctattcggagaaccaaaggctttgaggttatcctcggcccacccatctgatgggagtgtttctcaaacttgcttttccgtgatctcccagtaagaaatacctactacacacacacagtctccggtcggcatgcttagggtagtcttccaattccccctcctggtatttacaccctggagtggtccgctcctcttgggctgaacctgtaacttgctcccaagcaagagcacacagcaagctcacgcacgtggttgttggtgtgattctgtttctccagattgtctccattcctccctggcttctccacagggccgctcaccatggcagccggctccatcaccaccagccagcgagagggcaagacaagagggctgacgagggacgctaccatcacagaggtcagttttgtaacctaaccacaagactaacctactgtcacttctgccctatcctactgctagaagccagtcgctacatctcccccacactcaaagggaggtggtcgcaccgtggggtccactggaagttgcctaccagactcaggtcatcccaaacacaccctctagccatttggtgtggcatcggaaagaaaactaaggccaggtacggtggctcatgcctgtaatcccaacaatttgggaggccatggcggaagggtcacttgagcccaggagtttgagaccagcctgggcaacatagcaaatgttatgttgccacctctacaaataattagccaagtgtggtggcatgcacctgtagtcccagatactcaggaggctgaggcaggagaatcacaggtcgaggttgtagtgagctgtgacggcactgcactccagccttggcaacacagtaagacctcgtctctaaaaaagcaaaaagggctgggtgcactggctcacacctataatcccagcactttgggaggccaagacgggtggatcacctgaggtcaggagttcaagataagcctggccaacatggtgataccgtctttaattagccaggtgtggtggtgggcgcctgtaatcccagctactcgggaggctgaggcatgagaatcgcttgaacatgggagacacaggttgcagtgagctgagatcatgccattgcactccagcctgggcaacagagcgagactaggtggctgttctgtgtactgtgggatattgagtagcatccctggcctccccagtatctcaaatatgaaaacatgttttctatctcgattactgagcttttcggtgcctccttcggttctgcacctaagctaagagccccttcatctcaccctgatctctatccagtttctaacacagcagtcttgtaagatgcccggacttaaacggttatttcctgtgaaacaggtgaaaggggctttcatctctaaaaagtcggaacttttttttttttttgagacggaatcttgctctgtcacccaggctggagggcagtggcatgatctcggctcactgcaatctccgcctcccagcttcacaccattctcctgcctcagcctcccgagtagctgggactacaggcgcccaccaccatgcccagctaattttttgtatttttttagtagaaacagggtttcattgtgttagccaggatggtctcgatctcctgacctcgtgatccaccgcgcccggccaagtctgaacttttgcatggcctgttgccctggtgataaactgatgccttgtttcctaaaaggaataaagccatgagttgcctttgttcagctcatgggcattcacccatgcacagaggaaaaataaaatctacgactcgggtacattttcttcttttttttttcttttaaatgagcaagtttgagagtctgcagtttggactaccatgagaattgataggaaggtgggagtcccaggcaatcccaggtcctgtagcagcagctggtggggttcccactccatgccgtgcagagcctgaactcaggatgacacctgcacctgctctctggctgggctctggcacaggaagccctcagcaaacacccccggcacagccatgccatagccagacaacagctcgctgtaccacaccatcatgggagacagcagttattctgagcatctcactgctgaagaaaccaaggctcagagaggaccatgcatgcacaaggtcccacagggacccaagaatccaccaagtgtcagacaacttgcccatgctcttcacggagcaccttggaaccctccccgacaggcaccgctggctctcctgacgtggcctgcaagtgcacggagccccttcctcctcggccattcccagtttagattcccaggggaagcatcagatggcccctctcccctgctggcagcagagcagacggaaccagccagagcccagggcagtgctcacctgcaggccagtccactgcggccagcaccgccccctagaacctactgcgggcatggcggccgccagtcctgggtctcccggctcaggtagtgccaggaagctgcgggcatggcggacagctgtcctcggtctggaggcgccatcctggctttcaaatctgctccagaggttatctggggaggggctgctccctcacagagggagcctctaagcccaccaggcgggcactttcagcccaaagcctccgggccacctcctcatcctcagcctcgggggccggggccttctgtttgagtccatcgaagtactttccggaaacatccgccagttcctccgccacggccaggtatgtgctgggctgggcggccagctcggggctcttgaccagcagccagaagatgggccctgcaatcagcccacagggcatttagtccacactcgctcagagagaaggaaggaagccccgctccccggtcagggagctccgggtccctggagtcccacagagccctcctctagccctttccccttggctgcctccatctgcagttcccttccctggcactgcccaggcaaatcccaccagaccagggatcagaccaaaagctgcctcccccaaggagccttcctggctttgtccaggaaaatggaagctctcttcctcttggtcagccccagtcctcaccctaccccatttctcctttaataacatcttattaaatgcacctggcaccagcctcaggttaaggatctttttttggccaggcgaggtggctcaggcctgtaatcccagcactttgggaggccgaggcgggcggattacctggggtcgggagttccagaccagcctggccaacatggtgaaaccccatttctactaaaaatacaaaaattaactgggtgtggtggcgggtgcctgtaatcccagctgctcgggaggctggggcaggagaatcccttgaacctgggaggcggaggttgcagtgagctaagatcacaccattgcactccagcctgggtgacaatagcaagacttcgtctcaaaaaaaaaaaaaaaaaagggctgggcgtggtgactcacgcctgtaatcccagcactttgggaggctgaggcaggtggatcacctgaggtcaggagttcaagaccagcctggccaacgtgtgaaaccctgtctcaactaaaaataaaaacttagctgggtgtggtggtgggcgcctgcaatctcagctactttgggaggctgagacaggagaatcacttgaaccgaggaggcagaggttggagtgagccaagattgtgccactgcactccagcctgggtgacgagcaaaactccgtctcaaaaaaaaaaagacatttatttatttatttattgagacctggtgtcttgctctgtcacccaggctggagtgcagtggtgtgatctcagctcactgcaacctctgcctcccgggttcaagcgattctcctgcctcagcctcctgagtagctgggactacaggtgcacaccaccacacctggctaatttttgtatttttagtagagacggggtttcaccatggtggccaggctggtctcgaactcctgacctgaggtaatccgcccaccacagcctcccaaagtgctgggattacaggcgtggctattagcctcgccaagttaagattcttgatgccaaccaatcacccactccatgtttttcaggattataaacactagtcataaagcatgaactgcctgggggtggtggctcacacctgtaatcccagcactttgggaggcagttggatcacctgaggtcaggagtttgagactagcctgaccaatatggtgaaaccccacctctagctgggtgtggtggtgtgcacctgtaatcccagctacttggagacaggagaatcgcttgaacctgggaggtggaagttgcagtgagtggagatcatgccattgtactccagcctgggcgacagagcaagacttcatctcaaaaataagtaagtaaagctccaactgtttgttccacctattctctgggcggggtcctgtgctggccctttcaaggaaggtctcgtataacccccccagtgactgtgaggtgagtcctattaaggcctgcactctgcagatgaagaaacaggctcagaggggtaacagctcttccccaggaggtgcagctggtttggggtgaagctggagttaccctgagtacagcctgactccaggcgtcagctccacggcctcttcctctgagacacggttttctcatccgccagcagggctctgcctgcttcccggggctgttagaggctggcaggccaggtcaacggaggaaagggacctgtgctctgtgcctcagaagacgtaggcgaggagcaggcatgaggcctcagggacggtctctgagggagggtcctgggccctgggctgagaaagcaggggtggagggctccacgtggagaccccaggctgggaggggactcaccgagtgtggtgctggagaaggtggagccatggatgcccgtgtgtctgcccagctctgtcctggccacgccggggtgcagggcgttgacagtcacaccagagcctggggaagaaagaaagagaagactgagggaggggtccagcctcacctgggaggctgtggcagcccacacccagctgtggggcttccgggcaccaggctgcttcctgcactcaaaccccatcgtccctcttgctctggaatcttagtgaagtggtcttatcttgcggagcggctctgccacatggctgctgggagccgagctttcctggagggcttcataaacccagaacgctgagcttaccccgggagcctgcatcggtgcgtggcggtgggacctaagatactgtaactctgaccagctcccagtggggctggcaccgctggtccacagaccgtctttcagaagcaaaggcctagcacagatttctcaatctcagcactgtggatgctgtgggttgggaggagtgaggggccatcccgtgcgctgtaggacattgagagcatctgggcctttaccctccagatgcccagagcaatctctccccaagccagctgtgatcactgtgtttccaggcattgacaactgcgggtcaaaactgcccctggttgagactcactggctggagccaaaaggctgagctgcctgcccaacagcagcagggaaggacatctgatccaggcagactagaccacctgggatgaacagacaatcctcagaagaacgatcgattagtgatgtctgcttcaggcaccagaagcgggcagcgtggtccacatgctctacttttgctgactctgttctggatccaccgtttggcctcccatcagcctaggatcatggaaaggccgctctaggctcagagtaaagcaagagggaggccgagcctagcgcccccgtaccttgcagccgccggctcagctccttggtgaagaggacgatggcgagcttgctctggcagtaggcggctttggtgttatacttcctcgtctgccagttcaagtcgtcaaagtctatgtgcccagcaacatgggccagggacgagaggttgatgatccgcgaaggggctgaggctttcagcttgtccagcagcaagtttgtcaagagaaagtgacctggattaaggatgatgaaaaggtcacttttgactcacacctaaaatcccagcactttgggaggacgacgggggaggatcgcttgaacccatggtgcagcccctgcccaggcctcacccaggtggttaacgccaaactgcatctcgaagccgtcctcggtggtccagtgggggcaccgcatcacacccgcgttgttgattagaatgtccactcgctcctcctctggaagagaggggtggaggaggagacatcccggtgaggacagaccccagcctgatgcaccagcagaaacactcctgtgctcccacaacctgtgaatgtggcctgtgccggaaacagggtctgtgccgaagtggccatgtcaggatgcggtcattagggtgagccctaatccaatgactggtgtccttataggaagggaaaacagagacagagacacatggggagaaggccatgtgtggacagaggcaaagaccggagaggcacagctccaaggtgagggtgggccgcccccgctggaagtggaagaggctgggaggattatggcccgtctcacaggtcacagccacagggacaccgcgattcagactgccggcttccggaaccgtgagggaatgcacgtctgagggtgtaagccactgggtttgcagtacattgttacagcagctccaggacactcacacgccctccgcacctccatctaagccttgggactccttcctgccggagccccgaggccaaaaacgggaggttaccggtgggagccccggcaccgcaggcgtggtttcattcccaaacctgccacctcactcatacaagcaaccaaaggacacacagatggagactgcagcctcagtttcctcagctgtaaaatgcgctgaaccacagggccttcctccctgtaccactcagctcgggttccgtaacaaagtgccacagacaggtggtttaaaacctcacagacctggccgggcacagtggctcacgcctgtaatcccagcactttgggaggccgaggtgggcagatcacctgaggtcaggagtttgagaccagcctggccaacatggagaaaccgcgtctttactaaaaatacaaaattagccaggcgtggtggcatgcacctgtaatcccagctactcaggaggctgaggcgggaaaatcgcttgaaaccaggaggcagagggtgcagtgagccgagatcgcatcattacactccatcctgggcaataaaagcaaaactccatctcaaaaaaaaaaaaaaaaatcacagtcccagaggctggaagtcccagatcaaggtgtgggcagggctggttccctctcagggccctcagggaggatccgctctggtctctctccttggctcacaggtgaccatctcctctctccctcttcccttcctcttccctttggagctgtctcttttttttttttcatttttccttttttaattttagatttttcagacatggtctcactatgttgcccaggctggtctcaaactcttgaactcaagcaatcctcctgctttggcctcccagagtgctgcaatttcactgcccccagcctatttttttttttttgggggggggagatggagtttcactcttgtcacccaggctggagtgcaatggtgcgatcttggctcactgcaacctctgcctcccaggttcaaacaattctcctgcctcagcctcccaagtagctggactacaggcatccaccaccacaccgggttaattttttgtatctttagtagagacggggcttcaccatgttggccaggctagtctcacactcctgacctcgtgatccacctacctcagcctcccaaagtgctgggactgcaggcgtgagccaccacactcagtctacttggcctattttttatatttctttgagacagggtctccctctgacacctgggctggagtacagtggcgcaatcactgctcactgcagcctcaacctcccaggctcaagcagtcttcttgctcagcctcccaagtagctggggccacaggcatgcgccaccatgcccagctagcacgtctgtttctgtgcgcaaatctccccttttcataaggacaccagtcactggattagggcccaccctaatgacctcattttcacttcaggacctctgtaaacacccacctctaaatgaagtcacatgctgagggatgggggttcaggatcccaacctatccttgggggtggaggacacaatggaattcataatgctcccgaagtggttttcggcggggatcgtgaattaggtgtccagcgcgtaacacacagacaccatctggttctctgtgtgagaaggagggggttgcagcacacccgtcatgaataccagctctggagcaggacagacaggttcaaagcctggctccaccccgaccagctgcatgatcctggccaagtcacatcacttctctgtgactcagtttactccttgtaaaaaaaaaaaaaaaaaaaggataataacatcacctgcctggtacaactgtatacttactcattcagtaagtattttctaagcacctattactgggcactggaaatacagggtggacagcacagccgaggccccgtccgtgtggaccggacattccagtgcagctgagagccacttccactcgtgagagaatctacccgtgacagagctgcgtggaagctgacaggaggcccctctcaggaggtgacgcagaaactgggaccgggaaaatgaggcagggcccacgtgcggagacccagggaagggggatgcaggcagcaggcgcagcacgggtaaggcccaaaggcgggacagggagactccactcacagctgggcgcccaggagtgccgccagcttctggtgttttgttttggttttttttctttttttttttgagatgaagtctcactctgccacccaggctggagtgcagtggtgtgatcttggcccatggcccactgcaacctctaccgcctgggttcaggcgattctgctgcctcagcctcccgagtactgggattacaggtgcccgccaccgcaccctgctaatttttgcatttttagtagagacggggtttcaccatcttggtcaggctggtcttgaattcttcacctcgtgatccacccgcctctgcctcccaaagtgcagggattacaggtgtgagccaccgcgcccagcctgtttttttttttttctttttatgagagggaagctcactcagtggcccaggctggagtgcagtggcgcgatctcagctcacagcaacctccgccgccagggctcaaacgatcctcccacctcagccttccacatagctgaaccacaggcgcccgacaccacaagcagctacttttaaaattttttgtagaaatggggtttggctatgttgcttaggctggtctcgaatttctgagcttaggcaattcgcccacctcggcctcccaaagtgctgggattgcaggcgtgggccacagtgcctggcctgttgttttgtttatctgggaactgcctcaactttttttttttttttttttttttggacacagggtctcaccccgagtgcagtggtacaatcaaagctcactgcaggccgggcgtggtggctcacatctgtaatcccagcactttgggaggccgaggcgggcagatcacctgaggtcaaccagcctgaccaacatggtgaaaccctgtctctacctaaaacaaaaaagtagccgggcatggtggcaggtgcctgtaatcccagctactcaggaggctgaggcaggagaattatttgaaaccaggagatggaggttgcagcctgaccaacaggaagaaaccccgtctctactaaaaatacaaaattagccgggcgtggtggcgcatgcctgtaatcccagctactcgggaggctgaggcaggagaatcacttgaacccaggaggtggaggatgccgtgagccaagatcccgtcattgcaccagcctgggcaacaagagcaaaactccgtcttaaaaaaaaaaaaaaaaaatccctcactgcagcctcaacctcccaggctcaagcaatcctcccacctccacctcccaagtagttgggactacaagtgcacaccatcacgcctgcctcattgttttttattttttttttgagatggagtctcactctgtcacccaggctggagtgcagtggcgccatctcggctcactgcaagctccacctcccgggttcacgccattctcctgcctcagcctcccaagtagctgggttacaggtgcccgccaccacgcccggctaatttttttgtgtttcttagtagacacggggtttcaccgtgttggccaggatggtctcgatctcctgaccttgtgatccgcccgcctcagcctcccaaagtgctgggattacaggcgtgagcctgcacgcctgcctgattgttttgtattttttgtagagatgaggtcttgctatgttgcccaggctgatctcaaactccctgataaacaaggctgtgggtacctgcttcctggggctctttgctttgtgttctttctagtcgggagctgggaagagccacagcttccagctttgtcagagtgtcatctcacaaactgatcttcccaaaacttctgtctcccaaagtgccgggatgacaggcgtgaaccgctgcacctggcctgccccagtgtggtagaatacacaccacataaaatggacgatcttcactatttttaaatccactgctgtctttattcctggctgttgatcttaggaaaacaccaagaagctggtacttgatttgctaaaaaagtcacagacacagctttacttaatcctctagagaggctgggcgtggtggctcatgcctgtaatcccagcactttgggaggccgaggtggctggatcatgaggtcaggagatcgagaccatcctggctaacacggtgaaaccccgtctctagtaaaaaatataaaaaattagccgggcgtggtggcaggcgcctgtagtcccccgccactcgggaggctgaggcaggagaatggcatgaacccgggaggcggagcttggagtgagccgagatgtgccactgtcctccagcctgggcgacaaagcaagataccgtctcagaaaaaaaaaaaaacccctctagagaatcccagaaaatagaaggaattattccatttcccggaagaggaacgtgtggctaagagaggaggcatcacctgcccaggtgtgtccagccggggtcctcactgtctcagggacctcagtgctccggacacctgtgtccacaagccagagacaggatcagaggcgccctgggtgggattgcctgggacagtgtgcatgaaggtgacagtgctgtacctggtacacagcaggtgcttaataaatgttcatccacctctgagactctgaggcattgccctctcactgttctttgtgatctcaccgtagtgcctctcacctacccgacaacagtgccggctctttcttgatccccaagggcacagcaggggctcagtatgaatgaatgaatgaaccaacgaatgtgcacctgcacctgcctccctagggctgtgagtggcacaaggacagctctggttcatctcacacctccagcacctggtcaggtctgagatcacgtctgctaaataaatgaggtcccacaactcccccattccttgttcatttcctgagtacccgtttactgagcggggcacattgactctgaagaagaaagctttggccctttcagtgccagactagaaaagaaacaaagcagctgggcatggtggctcatgcctgtaatcccagcactttgggaggctgaggcaggcggatcacaaggtcaggaattcgagaccagcctggccaacatagtgaaaccccgtctctactaaaaatacaaaaattagccgggcatggtggcacccgcctatagtcttgggaggctgaggcaggagaatcgcttgaacccaggaggcggaggctgcagtgagccaagatcgcatcattgcactccagcctgggtgacagagcaagactccatctcaaaaaaaaggtcttgctctgtcatccaggttagagtgcagtggcacaaatacggctcactgcagccttgaactctcgggctcaagtgatcctcttgcctcagcctcctgagtagctgggactgtaggcacatgccaggatgcccggctaatttttttttttttttaatctttggtacacacaaggtctcactatgcttcctaggctggtctctaactcctgagctcaagcaatcctaagagaagagattttaaatgtggtcaccacaaaaacaggtaagtatttgaggtaatgcatatgttaattagcttgatttagccattctacaatgtatacaatgtacatcatgctgtacataatatatacaagtatacatgtcaactaaacaataaataattttagtgtattcttgagtctatttaaagatgaacaagaatagaaaagctagaggatggtcccagttttacataaaaatatataaatacacacacaaacctattataaacaagactagaaagatccataaaagtgattctcctggggctggtgcagatcaaagttgtttagttctgtcttcttttttattgagacagagtctcactctgtcacccaggctggagtgcactggcacaatctcagctcactgcaacctccgcctcctgggttcaagcaattctcctgcctcagcaccctgagtagctgagattacaggtgtgcaccaccacgcctggctaatttttgtatttttagtagagacagggtttcaccatgttggccaggctggtctcgaactcctgacctcaagggatccacctgcctcagcctcccaaagtgctgggattaacaggcgtgagccactgtgcccagccagttctgtcttctttacattgcagtattttataaatgtcccataacaaacacatatttctttaaccatggtggggaaggcacttgatcaataaatgcttaataaggtcaggtgcggtggctcacgcctgtaatcccagcactgtgggaagctgacctgggtggatcacttgagcccaggagttggagaccagcctgagcaacatggtgaaaccccagctctaaaaacaaaacaaaacaataaaacaataattagctgtgtgtggtggcgtatgcctgtactcccagctacttgggaggctgaagtgggaggatcccttgagcccagcaggttgagactgcagtgagccatgactgcaccactgcactctagcctgggtgacagagatggatcctgtctcaaacaaactaattattcaggtagggcacggtggctcacacctgtaatcccagcactttgggaggccaagggaagcagatcacctgaggtcaggagttcgagaccagcctgaccaacatggtgaaaccctgtctctacctaaaacacaaaaaattagccaggcacggtggcgggtgcctgtaatcccagctactcaggaggctgaagcaggagaatcatttgaaatcgggagacggaggttgcagtgaggcaagatcacaccactgcactccagcctgggcaacagagcgagaccccatctgtctcaaaacaaacaaacaaaacaaagtcagccgggcgcagtggcccacgcctgtaatcccagcactctgggaggctgaggcaggagaatcacctgaggtcaggagttccagaccagcctggccaacgtggtgaaaccccgtctctactaaaaatacaaaaattagcagggtatggtagcaggcatcttaatcccagctactcaggaggctgaggtccgcgcttgaacccaggaggcagaggttacagtgagccgagatcgcgccattgcactcagcctggccgacagagtgagactccctctcaaaataacagtagtaataaataaataaagtcgttgcttgcaggctgtacaaaaaaaggcagcaactggacttggcccctaactcatagtttgccaaaactctgctctaaagtttgcttgcttcattcacttctcagagcctggccctgggagccgcctatcccagtcctcatcccacatggccagcgttctcctaccttcaatgatctttgctgcaaactctcggatagacttgagggaagccaagtccaggtgccgggcgttgacatggtgattgagggtctccccgcggatgtcctttgctgccgcctcacacttctccatgtctcggcaggccaggatgatgttgcctcctgaaaacccaggatggaaaaagatttaaattaataatccactcctgggtactgaccccagagacatgaaaacatacgtctacacaaaaacacatccaccaatgttcactgcggcattcttcacaaaagccaaaaggtagaaacaaccaaatgcccatctgtggatgaagggacaacaaaatgtggtccatccatagagatggaatattagacggccgtgaaaaggagtgaagcactggctcatgctacagcaaggatgaccgtcagaaacactgtgctcggggaaagaaaccagacacgaaagaccacacagcgtacaatcccatttacatgaattctatgtatatgatttcacacctatgaaacgcccagaataggcaaatccatagagaaagaaaatagattcttggttttctagggcagggggtggggagagggaattacagcttgatagttacagtgagcaggtttctttctagggtaacagatgttctaagattgattttaaagatggttgcatcattctgtgactatactaaacatcactgaattggtcgggcacggtggctcacacctgtaattccagcactttgggaggccaaggcaagaggattccccatcctctccttttttttttttttttagatggagtctcactctgtcacccaggctggagtgcggtggcgcaatctcggctcactgcaacctccacctcctgggttcaagcaattctcctgcctcagcctcccgagtagctgggattacaggcacctaccacaactagctaattttttatttttttatttttagtagagacagcggtttcaccatgttagccaagctagtcttgaacttctgacctcaggtgatccaccccgcggcctcccaaagtactgggattacaaataagccacaatgcccagcctccaattttttttgttgtggtaaaatacaaatcacttaaaatttatcatcttaacccccttttctttttgtttattattatttttttttttttgagtcagtctcactctgctgccgcggctggagtgctggcgccatcacagctcattcagccttgaactcctaggctcaagtgacctgggactataggtaccacctgtgccagcatgcctggctaactctggtagagatgggggtgttgctatggtgtccaggctggtctggaacccctggcctcaagtgatcctcctgcctcagcctccaaaagtgctggaattatagatgtgagccaccgagacccgccctcttagccatttttaagtgtccagttcattggtattaaaaacatttatggctgggccgggcatggtggctcacacctgtaatcccagcactttgggagaccaaggcaggtggatcacctgaggtcaggagttcaagaccagcctggccaacacattacaaacttagctgggtgtggtgttgcatgcctgtaatcccagctactcgggtggctgaggcaggagaattgcttgaacccgggaggcgaaggttgcagtgagccaagatcatgccactgcactccagcctgggcgacaagagcaaaactccatctcaaaaaaaaaaaaacaataataataattcctaatgttgtgcaaccattacaaccatccatctctcaaattgtttcatcttgccaaactaaacttccgtttccattaaacagtaactccccattctcccctcccctcctgacccctggcaagcaccattccaacttctctatgaatttaactgtaggtagctcctgtaagtggaatcataccgtatttgctcttctgtcgactggcttatttcacttcatggaatgtcctcaaggttcatctgtttcaatgcccttttttttgttttgctttgttttgttttgtttttgagtctcactctgtcacccaggctggagtgccgtggcgccatctctgctcactgcaacccctgcctctcaggttcaagcgattctcctgcttcagcctcccaagcagctgggactacaggtgcccaccacaactcctggctaatttttgtatttttagtagagagggggtttcaccatgttggttaggctggtctcgaactcctgacctcgtgatccgccagctttggcctcccaaagtactgattacaggcgtgcaccaccgcgcccggccagaatgcccttcctttttaaggctgaatcatatgcccctgtctatagaagccacattctgtttccctgttcatctgtggatgggtgcctgggttccttccacctccggactgtgaataatgctgcagtgagcatggatgtacagatatctctctgagagccaaagcaggggagattttacctctcctggccagttccaaggcggtctgcttcccgatgcctgtgttggcacccgtcacgatgaccgtcttcccagggatggtggccttgctggggcaagccccaccggtgacatagtccctgagggtgagaagcggcacggtcagtcctgtgggcccactctcaccccacgtgcccctgactgaatgatctcaggcaaccttgtctgagctcactcacataccccaactgaaacacagacatcatcacatcacaccaagggacctctgtcatgttctccataagtggctccacccagtgtctggcgtgtggaacgccttcagcaagtgacagtcattattttataaatgctcactgcatgagattcccggccaggtgagggggcttgcacctgtaatcccagcactttgggaggccaaagttttgggggtgggggggggcgggggcggatcacttgaggtcaggagttcgagtccagcctggcaaacatggcgagaccccgtctctacttaaaatacaaaaattagccagatgtgtagggaaaagagagattagactgttactgtgtctatatagaaaggaaagacataagagactccattttgaaaaagacctgtactttgaacaattgctttgctgagatgttgttaatttgtagctttgacccagccactttgacccaatctggagctcacaaaaacctgtgttgtatgaaatcaaggtttaagggatctagggctgtgcaggaagtgccttgttaacacaatgtttccaagcagtatacttggtaaaagtcatcgccagtctctagtctcaataaaccaggggcacgatgcactgcagaaagctgcagggacctctgcccttgaacacagagtattgtccaaggtttctccccgtgggatagtctgaaatatggcctcgtgggatgagaaagacctgaccgtcccccagcccaacacccgtaaagggtctgtgctgaggtggattggtaaaagaggaaagcctcttgcagttgagagagaggaaggccactgtctcctgcctgaccctgggaactgaatgtctcggtataaaacctgattgtacatttgttcaattctgagacaggagaaaagccgccctatggcgggaggcgagacatgtttacagcaatgctgccttgttattctttactccgctgagatgtttgggtggagagaaacatcaatctggcctacgtgcacgtccaggcatagtaccttcccttgaacttaattatgtcatagattcttttgctcacatggtttttgctgacctcattatcaccctgctctcctactacattcctttttgctgaaataatgaagataataatcagtaaaaactgagggaactcagaggccggtgccggtgcaggtccttggtatgctgagcgccggtcccctgggcccactgttgtttctctatactttgtgtcttatttcttttctcagtctctcgtcccacccaactagaaatacccacaggtgtggaggggcaggccaccccttcacaggcgtggtggtgcacacctgtaatctcagctactcagggggctgaggcacgagaattgcttgaacctggaaggcggaggttgcagtgagtcgaaatggtgccagcctgggcaacagagcgagactctgtctcaaaaaaatttaaatttaaatttaaaatgcccgctgcacgagattcccaaggctgctgtacgcattaccacagacttagtggcttaaaaccacataagtgcatcctcctccagttcggcaggtcaagagtccaaaacatgtctcactggaataaatcaaggtattggtagagtcaggttccttctggaggctctagggaagaatccacttccagctcctacagaccgccacattcctccactcttggccccgcctccatcttcaacctgcatcctcactggaacctctcctttatttatttatttatttacttatttatttttgagacagagtctcgctctgtcgcccaggctggagtgcagtggctcaatctcagctcactgtaaccttcgcctcacaggttcaagcgattctcctgccttagcctcctgagtggctgggattacaggcacatgccaccacacctggctaatttcttttgtatttttagtagagacagagttttaccacgttggtcaggctggtctcgaactcctgaccttgtgatccgcctgccttggcctcccaaagtgctgcgattacaggcgtgagccaccacacccaacaacctctccttctatcttccatctcccctctgactgagcctcctgctccctcttataaggaccctataagactacaaggcaggaccggcacagtgcctcacacctgtaatcccagcactttgggaggccaagacaggaggatcacttgaggtcaggagttcgagaccagccatggccaacatgctgacaccccatctctactaaaaatacaaaaattagcagggcttggtggtgcacgcctgtagagtcagctactcgggaggctgaagtgggaggaccacctgagcccagggagggtgaggctgcagtgagctgtgacagcatgactgcactccagcctgggtgacagagagaccctgtctccaaaaaaaaaaaaagactacatgataatcataagatccttcacttggccgggcacggtggctcacgcctgtaaccccagcactttgggaggccaaggtggccagatcccctttggtcgggagctcaagaccagcctgaccaacatggagaaacctcgtctctactaaaaatacaaaattagacaggcgtggtggcacatgcctgtaatcccagctactcaggaggctgaggccggacaatcgcttgaacccgggaggtggaggttgtggtgagccgaggtcgtgccattgcactccagcctgggcaacaacagcgaaactctgtctcaaaaaaaaaaaagatgcttcacttaacacatcagcgagaacctctgacacgtgaggtaatgtcgtcacaccttccgaggattaggacgtggacccctctacggagtcacgactctgcccaccacacccatgtcccacagaggctaacgctggcaacaagatagtgtccagcaacaggaggctgagcaggtaaacagcactgcacccacaggagagaagggcaccatgcaatacagtggccaccagccacagaggctaatttttaagaaagtttaaattaagtaggctgggcgaggtggctcacgtctgtaatcccagcactttggaggccgaggcaggcggatcacctgagggcaggtgtttgagaccagcctggccaacatggcaaaaccccgtctctgcgaaaaatacaaaaattagccgggcgtggtggcgcacgtgtgatctcagctcctggggacgccaaggtgggaggatcacctgagcccaggaggtcaaggctgcagtgagccaagatcgcgccactgcactccagcctgggcgacagagccagattctgcctttaaaaataaacgaacaaataaataatacaaaacaacaaaataaagagtttaaaagtctggaaggaaagcaacatttacaagggcccaggctcgcccttccctccgagtgaccttgggccggtgacctggccggccagagcgcaggtttgccccactccgggcgggcactgcgggtcgggagctacggggcctggacccgggtgcgaggggcgggggtctccgccgccttcccggcccctgcgctgggggcccgccttgaccgcgcacgcggggctagaatgtactcacttgagcagcacggcggcgcctgctaccgtgcccagcgccgacagcggcagcaggtagcggctcatgccgggccggggacaggcgtcaggcgtcaggggtcggcgcggagcttgctgcacaccagccgcctgggtagctccgaggaagagcgcgcgacgcagccacaggcgagcggaggcgcaggcgcggctgggcccgcgtccggaactgggctgcgaggggcggggcgcgggcggagggggcggggatcctagggacgggacctatgagcatcggtcctgagcgctgtcacagctgggattggtggtttcaggagcctgtgggcgtggctagtccgggggcggggcctatggtttgttcgaatgacgtcacacttgccgcagcgtataaggcgctacgcagttctggagtgaaataggttcgaatcccaccactgtcaattccagactgtgaccctctgtgtgtctttcaactatatcagcctattccctcatctggaaatgtgtgtttaccttcttcatagacttttggagataatttgagaatttccatgcacagaaacaaggatctagtagcctgtgggtacccaagctcctggggtcctgcaggagaaggcggctgggggcctggactcctgggtctgagggaggaggggctgggggcctggactcctgggtccaagggaggaggggctgggagcatggacttctgggtccgagggaggagggccgggtgcctggactgctgagtctgagggaggaggggctgggggcctgattcattcccaaattatcagaatctcatccccatgtctggccctgcacagagatatcttccctgaactctgcctgaactacctttcttagattgagtattgcacacactcctgcacttacctgtccatgtttgtcacccccaccaaaccgggatgcacctctgggcacctgcttccccttgcactgctcacagcgagtgtatctgatcaccacctcctacccctgactgtgcctgaggtgccaggagcagacaccgctggaaacagggaagaattcaacccaatctaactaggagtaagttttcttcctcatcagatgaactgtcatcttcttatatgagccctgccataatggagattatacaggcaggaagagctattttaagaccttagtcaatggccgggcacggtggctcacgcctgtaatcccagcactttgggaggccgagacagatggatcacgaggtcaggagattgataccagcctggccaacatggtgaaaccctgtctctactaaaaatacaaaaattagctggatgtggtggcactcacctgtagtcccagctactcaggaggccgaagcaggagcatcacttgaactcgggaggtggaggttgcagtgagccgagattgccctactgcattccagcctggcgacagagtgaaattctgtcaaaaaaaaaaaaaccttaggcctgtagaccttaagctctcaccatctcaaacgtattaaaccagttacacaatgccaaatgctgtataagaggcacttggaggagtcaaattcatagagacagaaaacagagtggtggctgcagggggctggagatgagattgggaagtcacaggatttgtttttgtttgtttgtttgttttgttttgttttttgagagacagtctcactgtgtcacccaggctggagagcagtgggcgatctcagctcactgcaacctctgcctcctaggttcaagcgattctcctgcctcagcctcccgagtagctggggctacaggcacgtgtcaccacacccggctaatttttgtatttttagtagagacggggtttcaccatgttggccaggttggtctcaaactcctgacctcaggtgatccacctgcctcggccacccaaagtgctgggattacaggcatgagccaccgcacccggccgggaagctgttttttaatagatacagagtttgttttgcaaaataaaaaaaagacctgaaggtggacggtggtgatggttgcacaacaatgtgaatatacttaacatcactgaattgtacacttaaaatggttaagatggtacattttactttatgcatagtttaccaaactaaaaataaagaaaaattttagactgggcatggtggctcatgcctgtaatcccagcactttgggaggccaaagtggagaatagtatgagcccaggagtttgagagcggcctggacaacacggcaaaaccttatctctacaaaaaatacaaaaattagcaggtttggtggcacgcatctgcaccctcagctacttgggaggctgaggtgggaggtctgcttgagcccaggaggtcaaggctatgatgagctgtgattgtgccactgcaccccaggctgggtgacagagcaagaccccatctcaaaaataataataataaatgtttacatttaataacatgggcaattggttcagatgttcattttctcaaccttgaaaaaaaaacaacactgtttttccctgtctttttctccttttctgtaaactgaaatcctaatatcattgacttccaggacagagatcagcaaactttttctacaaacagccagatagtaaataatttcagctttgtgatccacacagtggctgttgcacctcctctgccagaggagctgggaagcagccacagatgatgtgaaaacaagtgagcacagctgtgttcccataaaactttatttataaaaataagcagtgcgccacagttcgccagctcctgtttgagagtctctctccgatgcccaggctggagcgcagtgatgcaatctcagctcactgcaacctctgcctcctgggttcaagcgattctcctgcctcagcctcatgagtagctgggattacaggcgctcgccgccacacctggctgatttttgtatttttagtagagacggggtttcaccatgttggccaggctggttttgaactccaggcttcaggtgatccacctgcctcagcctcccaaagtgctgggattacaaagcgtgagccactgcgcccagctacctgtcattgaatttggaaggatggcatgaagtcattcataacaaggacttaatccatagtaagtgccagaacattgctggctgttaatatggttattataaagagaacaatgcatgcatattcctcctctgaggatctcctacctgattcccagacacacccaagggagttagaacatctgtttggactccaggtgggctgtccacgcctttaccattttcctggttgttaacatgttcctgatcagcactgggtgctgtcccaggtgctgagaggattctcccacaatgccctttgctttccccatcagagggtttatggcacccaattctcattcacattctgtctctcctttctcgttcttctctatctctcctctctctgtctccttttctcttcctctctccctctctgtcttctctccctctctctccctctctcttcctctctctcttcctctgtcctcttttctctctctctctccctctctctcacatctctctttcccttcctttctctttcctctctcttcctctctccctctccctccttctgtcttcctctatccctctcttcctcttttttcttcctctcttcttgtctctttctctcctctctctctccctctttctctttctctctctcttcctctcccttcctcttcctctctctccttctttcttcctctctctcttcttgtgtgtgtctctctctctctgttctctctctccctctccccccaactctctttccctacacacatcttaagaggcctcagcagtgtaaggtaagtttagcgaccctgtggctgtgtagagataagcaaaggggggcaaggagctccagtggtcccagactccagccatttgagtctttgcagcccaagcactgccccagcttcttgacagccccagccatcaccaaagggcacacagataagctgcctccaccaaggcctgtgcagatggtaggtttttgagtaaaatagatatgatccttgtctgaagccactgagttttagaataatttgttatatggccatagtaactggaatgattgctgtaggtttattttattttattcatccttgctgcatgcaacacatgcatggctcagtaactagaaggaaagaagagaagaagggagggagaggcagagggtggacaggagaggatggtaggaaggaaagacaggaaaggagggtgttggtggccttgcctgcaagctgagcagacaccacgcaaacaggtgacctcccagttaagatggaggggactcagggctcaggaggggcagaaggtccccgtgtcggagagctgggcaagctttctgcaggaaatgatggggatcacggccatgtgagccggcaagatttccctcagccagggaggagactccgggctgtgggaacagcttaagcagaaggcatgggacaggaatgcatatgagagatattgtgggaggagggagggctgcctgggctggcatgcagggtatgggagggggtggaagggctgaggcgggagccatcagtaaaaggacccagagcgcggctccaatgccatggtaggaagcttggcgttgactcagagggcgctgggtaccgctgaagagtgttgagccaaggagggtcatgtcacgggcagatacatgttttagaatttcttcttttctggctgagatgtagagtatggactggagagaagcacaggggacataggaaaggtagttctagaaagaggggctgtcccaccagggaaagtcaaccaactgttccccagtatccattcctcccttccagctcatggcactaaagccactgattgattagctgggtgctatcaatctctctctcatctctctctccctctttctctccccctcatctgtgtcttttctctctctcatctctctgtctccctctttctgtccccctcctccgtgtctcctctctctctcttctctgtctcatatctctctcattgctctctccctctttctctccccctcctgtgtctccttctctctctctctttctcccccatctctctttctctcccccttcctctctttctcctctcactcttcctgtttctctctttctctttcttcctctctttctccctgtctctctcttcctcttttcctttgtctctctctctccccccaactctctctccctacacacatcttgagagacctcagcagtgtaagataagtttagctactccacggcctggcacggtagctcacgcctttaatcccagcactttgagaggccaaggcaggcagatcactggagattaggggtttgaaaccagcctggccaacatggtgaaaccctgtctctactacaagtaccaaaaaattagctgggcatggtggcacgcgcctgtagtcccagctactcggaaggctgaggcaggagaatcgcttgagcctgggaggcggaagttgcagtgagccgagaccacacctctgcactccagcctgggtgacagagtgagattctgtctcaaaaaaagaaagaggaggccgggcactgtggctcaggcctgtaatcccagcactttgggaggccgaggcatgcagatcacgaggtcaggagatcgagaccatcctggctaacacagtgaaaccccgtctctattaaaaatacaaaaaaattagccaggcacggtggcgggtgcctgtagtcccagctactcgggaggctgaggcaggagaatggcgtgaacccgggaggcggagcttgcagtgagccgagatcgcgccactgcactccagcctgggcgacagagcaagactctgtcaagaaagaaagaaaagaaaagaaaaaaagaaaagaataaagggagggagggaagggaaaggaagggaaggaaggaaggaaggaaggaaggaaggaaggaaggaaggaaggaaggggaggggaggggaggggaagggagggaagaaaggcaggccctgatgttcagggagctgagagtgaagtcaccggctccaacccaggatccaaactcaagtctgtctggggtcctatccccgtcaccaccccccgccccgacccatcccccagagacctgggaaggagccaggctcctccggtttcaggaaagggctgcacaaaccaccccgccacgatccctcccagagaacaaacagctcccggccaccggcagtctccctcctcctcctgccaggctggttcccagacccaccctccctgtgtcataagcgcctctccccgcactctcaccagggctggctgttctcagaggaacgcccaggaaaaacctacccgaacccctttcagctgggaaggggacccgcctgggcttcctcaccgccgatgagacctccctcgtcgtacacttagagctgcctgtgttttccttccttccttaagcgggctgggaactctagacactcagggatgggccagcccattagagtaagcattcggccacctctaggctgctacggtcactgctgctgtcaccatcaacgtgactgtctcacacctcacttcctccggccagccacacccctgcagatttaacccgccagcctccctaaggtttcctctgcctgaaatcctctctgcattcctggctcattctcgaaattgaggtcaaagctcagatgccgcctccttccctgaccaccctacctgaagcagccgcacctgcctgctcctagtcacgccgttccttcacctgtttcgtttcctccacagggtttaccacaatctgaaagtcttattcatgcaggtgtctacttgtttatctccccaccacacctactaggatgacaatatcacaagggctggggtttcatctgtctcctcctcctctgtatctccagcacatgaaacatgcttggcacactgtaggtgcttaagtatttgctactacatcactttgggattttgcataggacactcccaatgcttagaatgtcaatctttgcttcattgtccttggcaaactcctattcatcctttgaaaccccatccatttatcccttaaccaggaaaggcttctgtgcctcatacaaccacccataaagctggattagggctttctctggggacacccttgccctgtgccacacttccattagcgcacatatcccccatgaattgtgcacaccagcagggtctagagtacggcacacattttgtctcaggagctacgtattgaataaataaattaattactttttttgagacaaggtcttgctctgtcacccaggctggagtgcagtggtgcaatcgtggctcactgtaccttgacctcccaggttcaagcaatcctcccacctcagcctcccaagcagctaggaccacagatgcaggccactatgcctggctaatttttaattttttttttggtagggatggaatctccctatgttgcccaggctggtttcaaactcctaggctcaagggatcctcctgcctctgcttcccaaagtactgggactataggtgtgagacgccacactcagcctcattatttaatatgtaagtagctatatctctctgagacccagccccatctaatttataacctccctccttctcaagaacatgcctcagctcccattgccagggaatctgacctttctccttgtcataggatttttttttttttttgagtcagaatctcagtcagtcacccagcctggagtgcatggcgcaatggctcgctgcaacctctgcctcccgggttcaagtgattctcctgcctcagtctccctagtagctgggactacaagcgcacgccaccacacccagctacttttgtagagatggggtttcaccatgttggctaagctggtctcgaactcctgatctcaagtgatggcctcccaaaatgctgggtaacaggtgtgaggcaccacatccggctgtcataggaatttgtcagcaaatcctacagactagaggatgtgtgttgggtggtgtgggggtggggataacggaggagatggggggtgagctcttcaagccccaggggagaattctgttccgttcctgggacatcccaggtgagagggaagaaaggccagccccccaagacagctatcccagactgggacagaggcaaaccctgaccacagagccctgtcactcacccaagaacaggtgccaatgacagaatagccaggccgaggggggagagaggtgcttcggtgatggatttccctggtgacttgccaagacagggctttactgcctccgccctggactggctgagtcagactgtgcaggggtggacactttgactggtatttgggaggcatttgctgtgggttacagagagggaggggcctcctttgcggccagagaaggaggaaagaggccctgggccctgggacttgggacttgggtggaggctcgggtttcggtctcacctgctgctccagaccatggcctggagggccgcctgcgccacccccaaagcaatgagatagcccctcctccctcagacccaggagtccaggcccccagcccctcctccctcagacccaagagtccagaccccagcccctcctccctcagacccaaaggcctcggacccataccaaatgcttctatgagatagttttctccccttgttcatgaagaaatgagcccaggcccagtcagatctgcatctgtgtcacagcccagggccactgtaaccttaggctactgacttccctctctgagcctctgttttctcctgtcaatggggcaaggggtctgctccttccctcaaaccccaactcaggtacagtcaagcacagaaaatacttgtggcatgaatgtgatgagaacacagaattgcagaagccaaagaaagagaagcgtaagggccctccttccacccctacctcccccacccgctgctacacgcaccaggaccacctgctgggtagccaggagctcacagtctagccccgctggccacccctgcagcccccatccttcactcaggcagttgcagggcccagaacacccctatcttctaggattgacactggctgtcaaactcatccttcaaggtgattcctggcctgccctcctcctccaggcagcctgtcctcctcctccaggcagcctgtcctgaccctcagcagcctctcctggccttggcagagcccctcgtgtcctcccttgcagcacgcatgggaagaaaggccatcgtcctcgccattgctaacaccagccttgcgtttcctctttgccaggtactgtattgacaactctctataacctgactttatcctcccaataagctgggtgtggtgggtggctcatgcctgtcatcccagcacttcgggaggataaggcaggagtatcacatgagcccaggagttggagaccagcctgggcaacataaggagactctactatatatatgtgtatatatatttatatatagtctgagatgggaggatcaccccagtaggtcgagactgcagtgagctgtgattatgacactgcattctagcctgggccacagaactagaccttgtctcaattaagaaaaaaaatggggataataggacccattccataggatgtggtgaggattatgcatacacacacacacacacacacacacacatttatgatgtactgagaagatataagcacacaataagtatctccaaaattatcaagtggcaaagccaggattcagacccacacctgcccgaggctctctgccatcagaccacactatatctctttctctctgttccttcatccccatcaatcgaaggcaaaaatgtgccttctctgatttccaggctcactcagcatagaccgtggaggcaacatatcttgaatgaagcaacaaagcagtaatgcacatgaatgcaccaaatgccaaaagctcgtttactcaacaagtatctctccaacactttctatgtgctagacccaattctgtgtgctgcagattaagtggaggactgatcacacaaaaatctttgcccttgtgaagcttgcatttttttttttttttttttgagatggagtcttgctctgtcacccaggctggagtgcagtggagcaatcttggctcactgcaatctccacctcccgggttcacgccattctcctgcctcagcctccggagtaggtgggactacaggcacccaccaccaagcctggttaattgttttgtatttttagtagagacggggtttcaccatgttagccaggatggtctcaatctcctgacctcgtgatccacacgcctcggcctcccaaagtgctgggattacaggcgtgagccaccacacccggccgctttttttttttttaagatggagtctcgctctgtcacccaggctggagtgcagtggcacgatcatctcggttcactgcaacctccacctcccaggttcaagtgactctcttgccttggtctcccaagaagctgggattacaggtgtgcaccaccaactctggctaatttttttttttttagtagaaatggggttttatcatgttggtgacatggtgtgatctcggctgactgcaacctccacctccggggttcaagcaattttcttgtctcagcctcccaagaagctgggattacaggtgtacaccaccacccccggctaattttcatattttcagtagagacgtgctttcaccatgttggccaggttggtctcgaactcccaacctcaagtgatcaatccgcctcagcctcccaaagtgctgggattacaggcatgtgccaccgtgcccagcctgtgaagcttgcattctaacggaggagacacagacaaaatgaaccaggaacacagtgggtaagaaggtgaaaagttctccacacaaaaatgaagtagggagagaggaaagagactacaaagaagttgggttgccgggggcggtggctcacacccataatcccagcactttgggaggccgaggcgggcagatcacgaggtcaagagatcgagaccatcctggccaacatggtgaaatgctgtctctactaaaagtacaaaattagccgggcgtggtggcgcgcgcctgtagtcccagctactcaggaggctgaggcaggagaatcacttgaacctgggggggcggaggttgcggtgagccaagattgcgccactgcactccagcctgggcaacaagagtgaaactctgtctcaaaaaaaacaaaagaagtcgagtaagggatgccgccatttgaaacagggtggtcagccagtcctctgagaaggtgacattcaggcaaagatcaaaggaggcaagaaagtgaggcatgagggtatctggtagaagagcattccaggcagaggaaacagcaagtgcaaaggccctgaggcaggaccgggtctggatgttccaagagcagcaaggaggccagtgtgctgacacacagaaggaagagatgagatcagaatcacgtcccttaaggccttgcaagatgtcagctttttttttttcttcttttttgagacagagtctcgctctgtcgcccaggctggagtgcaatggcgcaatctcggctcactgcaagctccgccttccaggttcacgccattctcctgcctcagcctcccgagtagctgggactacaggtgcccaccaccacgcccggctaattgtttgtatttttagtagagacggggtttcaccgtgttagccaggatggtctcgatctcctgacctcgtgttccacccgcctcggcctcccaaagtgctgggattacaggtgtgagccactgcgcccggcctgttttctgttttttgagatggagcctcgctctcttgcctaggctggagtgcagtggtgcaattatcggctcgccgcaacctctgcctcccgggttcaagtgattttcctgcctcagcctcctgagtagctgggattacaggcacccgccaccacacctggataatttttgtgtttttagtacagatggggtttcaccatgttggctgggctggtctcgaactcctgtcctcaggtgatctgcctgcctcggcctcccaaagtgctgggattagagatgtgagccactgtacccatgcaagtttcttaacccttctcttcctcattttctcatctgtgagacgaagacagcctcccacccagacacactcccctcacggggctctggggagaaatgatgtggaaagctttgctagtaacctctacagcatggagggagttctggaaaagtgatttcagaaaggtgtttatgcctggaaagcctgttcatttttgtgatgtccttggagctgggccaggcattatcgagctaaatcttagcttttgtcagaataggggggtcattgagggaaatttccaaaggaaggtggaacgggatgggtggggaggtaagggcatgagcagaggcagtgatcgtgggcaggaggtgtccatagaagacgggctgccactggccctggagacagaaggtcagccccgggttcaaatccctccttaaccaagtgctgaaatggacaagttgctcaacctctctggccttcagcttcctcatctgtcaagcaggaatcaaacctcgaacttcctcccgctgttagaatttcaagggagttttaaagacagagctttcaactctgacctgtgaacaagtgtgacatcaaatgtactgttcgttgctattattctgttgctacaaggcagacagttagtttcccagctcccctgcagtccccccagcccctcctagatctgtctgccagccccgccccggggtcactccagccaggctgtgccaggtgaatgctcaggtatgcggaggcggaggcggaggcaggacggccctgggagggagcaggaggaggggccggcagcctggaagggaaaggacagcggagagcagggcagagcctgagcaggcaggtaaggagatccgggtcaggagagaagggggccggggcttgaccaatgggtctgagggacggggggactggggtctggactccagggtctcagggaggacgggctgggggtctgaactcccgggtctgagggaggagggcctggggtcctggactcctaggtctgagggaggaggggctgagggcctggactcctgggtctgagggaggaggagatggggcctggactcctgggtctgagggaggagtggactggggtctggactcctgggtctgagggaggaggggactggggtctggactcctgggtctagggaagagggactggggcctggacttctgggtctgagggaggaggggctgggggcctggactcctgggcctgagggaggaggggctggggcctggatgcctgcattgagggaggaggctggggtaggaattagaggctcctactggccaggccttcacatgtttgctggctcccagggcacctccaggtgggcaggagctaccactcagcaccatgagcaccgccacagggtaagcgcccccggaccccaggtcccagccccagcacgcctcccgcctcccctcgcctcctcacccacacccgcttgcggcagcccagactgtttgcggcggcccagactctggcccaagccccgacactcaggaggaagccagagcctctctcctccctgcccagcctggggttaggggcccccactgcagagcagacaggcctgagctccagttcggccctcacactcagtgctgatgtaaccctggtcagaggacatcacctcctggagcctcagcccctcctctgtgacacagggacaatgttgaaaaattggagggatagtgcattacaggacttagctgaccacctcactgacagcaggtgctcaactcataggagtcgctattgcgattgttatgttgttagtaaatattaaccctttgctagaaaatcagggctgtttataatgaagactcaagtcccccagagtaagcagggagaaaaacaatgagagatgagtcaaaatacctgcatggtaggtagtgagctctctggcccagaggtaatcaaattgtggtgacatcagactggcaggagcaggatgaggaacaggagtttgggaaaaagggtttttcagttcccctgacgccacctgatcgctgagcttctgttatgtgcatgcaagtggggattcaagaattcttaggaaaggtaatcttaggaagaaattgaggacgggaggagacagagaaggatgtggttgggaagcacctggcccatgggagtgggaggggaagcagataattccctgtctacttcagataccactaatgctattataaccattcccatttattgagcaacttctgtgtgctaagccctggcagcatcttaagaatgataataacagttattgaggcttcaaaatacttcacctgcatcatctgactgaatttgcccaacagccctaccagatggttactacgttacagaaagaaaaactgaggcaggagagattaaatcctcttctgaaggtcttatggcaaggaggcagtagacagagggtttgaatcccggactatgccatggtagagatcacactcccctaccacccagcaccaccgcctgacctgacctgtctttttttttttttttttttttttgagatggagtctcactctgctgccaggctggagtgcagtggcacgatctggactcactgcaacctccgcctcccaggttcaagtgattctcctgcctcagcctcccacgtagctggcactacaggcgcccaccaccacacccagctaatttttgtatttttagtagagacagggtttcaccatgttggccaagatggtctcaatctcttgactttgtgatccgcccacctctgcctcccaaagtgctgggattacaggcgtgagccaccgcgcccagcctacctgtcttcttaaagtccagctctggctctgagctctcctgctcaataataataataataataataataataataataataataacccttccatcgctccccattaccttcgtcatgaagcccttgctgccctgcttggcatttccacaggatctgcccccagtcccacagtctctctcattcctcttttcttcaccagcccagaagctgccccaaagccaagcgccaagtctatctatggtgagcggggggcaagggagccccaggcccatagaactgggtctaaagaaacaggacctggcatccagggtcttggaggaggaggggctgggggtctggactcctgagtcagagggaagaggtgctgggggtctggactcctgggtcagagggaagaggggctggggggctggactcctaggtttgagggaggaggggctgggggcctggactcctgagtcagagggaagaggtgctgggggcctggactcctgggtcagagggaagaggggctggggggctggactcctgggtcagagggaagaggggctggggggctggactcctgggtcagagggaagaggggctggggggctggactcctgggtcagagggaagaggggctggggggctggactcctgggtcagagggaagaggggctggggggctggactcctgggtcagagggaagaggggctgggggtctggactcctgagtcagagggaagaggggctggggggctggactcctgggtcagagggaagaggggctgggggcctggactcctgggtcagagggaagaggggctgggggcctggactcctgggtcagagggaagaggggctgggggtctggactcctgggtcagagggaggaggggctggggggctggactcctgggtcagagggaagaggggctgggggcctggactcctgggtttgagggaggaggggctgggggcctggactcctgggtcagagggaagaggggctggggggctggactcctaggtttgagggaggaggggctgggggcctggactcctgggtctgatggaggaggggctgggcctggactcccaggctcattctctttctcccctggcagagcagaggaagcgttactccacagttgttatggctgatgtatcccagtacccagtcaatgtgagtctggggtctgtgttcccccaggacatcttctggggcaaaggtggcctcaggagatagggcttttgaaagcagctaggcccccaagcaggaagcatgtggaaagtcagtttgcccatccataaaatggacctccgttgcctcacctcagtcatggatatgaagccaggggcctcgggtccacttaatctgccagcctttcctccaggccagctgttgtgctggacagtgggaccacggaggcaaatcaagacacagccctgcatgaggaaggggtagacaaggtccagaggaatccacagaggcgcctggtgctctaatggaggtggcagggggcatggcaggagacccgaggaggcatttagaaggagagagctataatccagactccttccctgcccgcaaggagcctccagtctgtgagaagccagactcaggtgctagtcactctgatgaaagggaaacaaag

SEQ ID NO: 469 - DNA, 26584 bp, Homo sapiens
ccttttccatcaagggccgcagcaagctgggcggcttcagcgacgacctacacaaggcaagggccaccccaactgagaacagagaatcacccccaaccatctgaaccctcccccggaacccaggacccaccagttcggccctgccttgccaatgcccctcagccccctcagcccttcaccctctgggcacctgccacgtgctggggttacactgcagtggtgaggaggggcaggcaacaggccagaagggagacgccctggccccagcatggaccgtgctgaggacaagagatggggtttaggaagcactgtctggagagagagaggcaatcttagatagggtagcatggaaagaagaggaggaggaaaaaataaaccatgagctatttgggggaggagggtcctggtttcagaaacagccagtgcaaagcccctgggtggcacatgcctgagagcttgaggggcctgagatggggaagcagcatcatggcacccaacagccctcgtccatgttgattttgccagccccaggccctcaggtccaacagggcagcaacagcctctctcacacacgctcagcgatgttcccaggactggcacacactggggatgccattgccagcgtgaggctgaaatggaggaagtgacccccacatgaggtaccccacaagcagtggggtgtgatctccacagtgtgacagaagacagaaggggaccttgatgcacgggcaccaacttgtagctgaccctgttgactcagagcctgagtttgctccctgtcctctagggccacacgccctgggtaggccgagttggtctgagcctcctttacctctcagaccccaggtcccgcagcctaccgccaaactgatgtgcgggtgaccaagttcaaggctccgcagtacaccatggctgcccgtgtggagcccccaggggacaagaccctcaagccaggaccaggcgcccacagccctgagaaggtccaggaagagcacagctcagaggggtcagggtggggcagggtcctggcccagagggatgtgtaggaaagagcagggaggggggctgggacacagacgaggggaaacagggtcaggctatggaaggacacagccaagaaggggtggaggggtggggtggggatgggaggcacctgcaccctgaggaccctgtacatttccagcactaggcccacaggtaacccttcagggacatggaagcagagaccctgcccttttccctagacactgtgacagctactactgctgagtgctctgtgttcaaacctgggagcatagcttctggccaccttggccccaggttcaggaaggacagcagcccagccccagccagggcagagacctgcaggtgggggcaggggtgctggttcctatcatagcccctcctctcccaggtgaccctgaccaagccctgcgccccagttgtcaccttcggcatcaaacactctgattacatgactcccctgctggttgatgtggaataacgccagccctgctgtgccccatcacacccggcatctacacaagatccgccgggccacagagctcgaggctgtcttcaccagctgggctgggccagcctggccctgcagggcagagcacgcttgtttgggcaattgtaatcagttactttttttctatgctattttaccattttttaatcttgttttctgctgtgcccaaattattaataaatcagattgcattaataagggtttgtcttggtggaaggatcaagcatttccagaaaggagcccccgtaggctgtcagcacttgcccacaaggggtcccatcctgccttctagggcccagggtcagcttggtgagatgggagggcccagggtctgtgtggggagagatggtagggcctgagtacctcagacaccctgctccacactgtccctcctgatgctttctgccttgaacccaaagatggccacacctgtgctcatcacctctgagcaatgctgggtcccttcccttgaatctggactatagcctgtgggtgtcctgagtaatgaggtatggcagaagtgatgccaccaggctcctgaggccacgcacacaacataccaaggaaacagcttccgcctggacaccagagcccaccccacccccacccttctgccacgtgtccatgtttgctccagcaccagccatcatgttgtgaggaagctcaaccatggcgagactgaatgcaccatcccaggcagtcggcccggccacaggcagtcgtcagcccggccacaggcagtcagcccggccaggccctccactcaccagcactgacctctggacctgtgagtgagccttcaagtgaaggcagccccaggaccacatctcccagtgaggcctcgacactgtagagcaaagacagccaaccctgaagcgtgccccgtctcaaattcaatgagacatgataaatcattgctattttaggtgaagttttagggtgacctgttacacatcaatgggtcatacagggagtacaaggaagacatggacagggaaggtggggtatccgctgggcctgaagaggaggatttccagaggctgcccaagagtccaaggccaggcctcaagaagtggagtctggatttcaactcaggctttcagggaggtcactttaggacgggtgacctcaacagacacactggtaggaccatcacctgcacctgtataaagcacagtacaactgctgaccttcacttcgctgtgatcgtgccaggctgtgtattcgaagcacttcatgtttactctcttttttttctttttttttctgagacagagtctcgctctgtcgcccaggctggagtgcaatggcacaatctcagctcgctgcaacctccgtctgccaggttcaagcaattctgctgcctcagcctcctgagtagctgggattataggcacgtgccaccacacccagctaatttttgtatttttagtagagacggggtttcaccatgttggtcaggatggtctcgaactcctgaccttgtgattcactcaccttgacttcccaaagtgttgagattacaggcatgagccaccgcgcccggccaactcacttattccctaagtggtgatgctatcaggatccccatctgcgtttcaggaacttgggcagggaagggtaacacagcaggaagtgggtgagtgtggggcaaagatcagactgttactgtgcctacctagaaaaggaagacaaaagaaactccatcttgatctgtacaaagaaaaattgttctgctttgagatgctgttaacctgtaacgttagccctaatcctgtgctcacggaaacatgtgctgtattaaatcaaggtttaagggatttagggctatgcagggtgtgccttcttaacaatatgtttgcagacagtatgcttggtaaaagtcatcaccattctccattctctattaaccagggacacaatgcactgcggaaagctgcagggacctctgtccgaggaagcctgggtattgtccaaggtttcccccaactgagacagcctgagatacggcctcgtgggaagggaaagacctgaccgtcccccagcccgacaaccgtaaagggtctgtgctgaggaggattcgtaaaagaggaaggcctctttgcagctgagataagaggaagccctctgtttcccgcatgtccctgggaacggaatgtcttggtgtaaagccgattattcgattattcgttctattctaagataggagaaaaccaccctgtggctagaggcgaaatatgctagcgatgatactgctctgttactctttgctatactaaaatgtttgggtaaagagaaacctaaatctagcctacgtgcacatccgggcacagtaccttcccttgaacttatttatgacacagattcctttactcacgttttccttctgaccttctccccaccatcaccgttctccctgttctcctgctgcactccccttgccaagatagtgaaaataatcatcaataaatactgagggaacccggagaccggcaccagtgcgggtcctcccacgcttagtgtgccggtcccctgggcccactgttctttctctatactttgtctctgtgtcttctttcctcagtctctcgtcccacctgacgagaaatacccacaggtgtggagaggcaggcccctttcaggtgagtctgtggctgctctgcccaaagtcaaccctgatggggtgaatgagggaaggggcagggtttacagcacctgtgctcatggccagccacggggtgaatgagggaagggacagggtttacagcaccagtgctcatggccagcctgtggaccagggtgagctccaaacaaaattccctcaaatcccaaggaaatgaggacgacagagaccatatgattagttcttcatgaggttatgtttactacaaatttttattgttaatgtttctcatcctgaaattatgggatacagcctagcagtttgtcctcacttggcagagtaggtaaccctggctctcacactgagcccccaagagtccttttggttttactggtgtcagggattacagtcagcaaaccccactcatttacagggtcaggtgtacagggctgagctggagggttagggtcagggcccctcaggaaactctggtctggcacagcagcagcagggatgccactctccctttgtggaatccttcttaatacaagagtgagaagcagaagagcaaaccacaaaggaattccagctcagaccccaaagtacctgggagagctgcaaacagccatggagataagagaggcggggagggaacacagtgactgagtctgagagacagcaaagcacctctccagcgaaagccactccgagatgcagcctaacttcctagtttgcatcagcaagatgagcaggcaccaccatggaaagagcacctggggtgtagctggttaccacagctcagccacattccccagaaacggaggtcagccctccatggcccaggaaaacatgggggatgaagggttggcacctgcagtgaccagatggagatacaatgcaggcagctgctaccatgcttggtgaccagggtacaagcccctgatgagcttgccatggcagccaaggacactggtgccggaggaacgacaggggcctgcaaagggacatccgaggagggggaagcaagctgggagcaagaccagcccagctaggtttcagggcaacagcaaagccccagagacatggaggcagatgagtcaaccttgctgggtgagaagtgagcttgcactgcatagggcaagaagaaggtggaccccactcctccaggaggctgacagtctcagccaggtacaatggagggtccaggtcacaaggaagggggctatggtgagcatggatggagaaaggtaggcttgctgtgtggaaggaaggaggaggggaggggaagggtgagcaaagtggggctgcaggcatcaggctgtggctgatctgtggtcagcctggagctcagaggcagttctggattgacaggacatatggtgtggccacacaggtggggggacagtgatcccatagtccccagggagtgactgggaggcagaagattggaacaggacagagaagggcaaagaagcacatggctcatgctttaaaggtgtttttatgccaagacaagggggcgaggacctcatcttgaggtgggaagaagtcgttgccctgccagtccagtggtttgaacatgaatccagcccagtggacagggaaggcccagggagaggtgggtagggagggcatcctgcagaggctggggacaaggaggatggcacagaatgccatcacagccaggggagtctggcagggcttggcggaggcgccaaagttaccagcaagctagaaggcaacaactgatagccctcacaggaaccttcttgtgtagacccacagaagctccctggccctgcctgctttgcctgactctgaaatgccagacaggcccatttctaggtctgttctcctgaaaatacatctttggtgctgggtagatcctgaatcctgagaatacaagtttctgctcctggatacacagtcacatgacccagaagatcccagcccagtggctaggccaaggctgcagtccactccttcatccacagcccgttctccccaagggtctcacttcatcgaaggcgcagataacacagtagggtggcctccactggtctgcccatgctcagcaaccatggccaggagtaactgccatctccagggtgagaagcctcggtcggaggagatgacacccacttagggttcacagccccttcctgtgtcagttccaggaaccttggatcacagacatggcctcacccagacaaggacacgaccgtgcagccttaagatgtcagagtcccaagcgcggggagaagggctgcaagccacaggtggccacgtctgggattcaccagctgctctgctcagacctggcttctccagacacgctgtggccccagctctgcctggctctctagcacctgggggaggggggaggggctgggccttggtttccccgagagagtccctttcacacatgggaccagccaacatgagctcatcaggtcacaggcagccgcagcctcctgccacacaggaagaagattcctgacccacaattatcattgcaaaggagtattttgtaggtaagtcctctggagcccaaaacaccaggcagggaagaccctggctgcccttggcacccacagacaccagctcccactggctcacgtccttgccctggacaagaagtaggagaggatgaagaaggccacaattagacccacggccatgccacatagaagcttccggttgtcttgtccggaccttgccattgtggaaaagcgcttcacgctccctgtaagcaggctggtcatgcttgtgaaatccgagtcctaagggaggaatcccagcaagatcacacagaagtggtgatttgaccacccacccgcaccagtgctgaaggagacactgcaggctctgcagcaggtagtgctagggcagggcactgatacacgcacaccgtgggcccttaccatgccatccaggtaccggttctgatcctctgcatccctatcgatgtccagggcgagctgttcagcagacagagagggcagggttgggccagagcagacacataatacagcactcaccctccccagaccagataaaccctgccaacaactctgccagacacagtggggctgcagcagacagaaaggtccaggtgtcagctggggcctcatgcaggtgagcacagccacgaattggatgaggatggaaaactgcctgaaactcctctgggccctctgccttccctctgatccccattccccaaaggcaccaggtggaggtaagaggacagaccaccactgaccgatttgagcctggtgactttggaggccaggctgtcagccattcgcttgttctcccggtctagaatctcttccacagcgcccgggctctgagctgagaaaagagaggggctgaagggttgcatccatcggtgagcacggcccctgacccctctcactccaaccacatctgggtgagtcagaaatctagggggccctaaccaaggttccagcaggtgaatcttgcacatgagacaggctgcataaaggacgatgtgtgtaagggcctgtcatgtgaacacatgtcctgtgtacacatcaaggtggggatgggcaagcacccacaatgggttcggtccaaccagcaccttctgagactgtgtagcaaaaactggacccagccctggggtgctagtatgatgtgacacttgcatccagggaggtcaccatctgtgtatgtggagcccattcttatagaaaaagagtaaactctgctaagagcatagaaaagacttgggaaaagtacccagcaaggcagcagaaaggctcctgcagagacgacctttgagctaggtcctgaagaggtggcaaggaaccaggacagaacattgggaaggccctttaccgcacagaaaatggctgagcaaagttcccaatttccccgagacgggagctgaggtcgaccaggagcgggatccttggtctgcatcccgcatggggcttcctgcaacacccagggcagagtgctcgcagaggcctggcctgtgacaggctgggccaggggataaggaagttctgtcacatcaggtgcgtgagaaccacctcctccctagcttcagtgtcaggaagggatgccagcgtccttccagccacttcatatttataaattcctttaatcatcataacacctcacagagacaggcatcaatatcccactttgcagacaagaacacgggctccaggaggggaaatggggccaccgaggccaaagtaagagtcctgcttggacaccagcggagcacagcctctactcctagggcctggcctcgggacctgtcgaatgccgactcccgctcaccccgaacccatgcagaacgatctcacagggggcggcggggagtggggagaccccgctgctgcgcgacccctcgctggagctgctgggccgccacgcgcgccttcggtcctaacggcagtgccggccgaaacccggccctgctcggacccggaaggatccgaatccgcccccctgacagggtcctctcggccgaggtcaccccagctgggccagaggcaggcgcacgcggctctacaggcagcggcgtcggtttcggcccggccctgcccccaacggctccgctctcccgcgctcaccccgagcccagtccgccatcgtgccctgccccggctcctcgacgcggacaccgacgcggccacagccgcctcagacgtggcgcagtcgcggggaaagagcttccggccccgcccccagctagcgatggccccgcctccgcaccgaccacgcccctagatagcccagccccttccgcttcgggctcgctgacttccggcttagggccgagggtggggaactgccgggcgcggaagcgatgggcatatctgtggcttattttcagcactgtcgcgcagacagtggcgcgatctcagctcactgcagcccccgcctgccgggctcccaaggtgctgggattacagcagcaccgcggatgtgacgtttggtgttcctgtgaacgtggggcggggcggggccgtttgcttgctcagtgcctagacgatggtggtggaaagacgcttctgtgggttaggtcctaacggttaggaaggattcacaggcgggtcatgaggaaggagcagacccctcgggcagaagcccgcgaggagcactgggtgtggtgggggcaggggtgcctcctctgtcaagtggagatcggcgcctcgctcgtgcctgcgagtgcgcgccgcgtcgaatacagccgtacagaacgcactacaggaaagtgaagccgggagagagactgggaggcggcgcggggactgggggccgtagacgcctttgctcccgggcacttgttagaagagcgagtggatcgcgcttcctgtgcgtcactgaatcctcatgacggccactgaaacggacacgcaggatctttgcttttcaagagggaactgagtccaggccagactgggttgctcccctttctctcggcccctccacctttgcaagtgctgctccttctgcctggagtggctcctccagtcttttcccggctcacttcccaccgtccggtgtcagcaaaaacagcacttcctcacagcccgttgcagcccagcagtcgccttttgcttcttttgaagcacagccctgtgaccgcctcgtgtccttttgtttttccttgtcccccttcccctctggaacataagctccacaaaggcagggacctgggaatcccgttcgcctgcattccccagcaaacgcctaacgaacccaatggcccaggactgaaaattcctttccacttcggctttcccctctacatcccatcggttctgtggagctcgaggggcgtcactgtgtgtgtggcagggcacggtgggggctgagatcgtttcctgttggaacttctggcccaagaagcgcgggtcacaaggagaggggtcagttcggttcagagcgactcagcccctcgactcgggtcttaaaacctccgagccgccagttctgcctcaggccgcgcccccttaaagcgccaccagacgctgcgccccgttaaagcgccaccagacgccgcgccccgtcccggcctcccccgcgcgctggcgcggggctttctgggccagggcggggccggcgaactgcggcccggaacggctgaggaagggcccgtcccgccttccccggcgcgccatggagccccgggcggttgcagaagccgtggagacgggtgaggaggatgtgattatggaagctctgcggtcatacaaccaggaggtaagcggccgcctgaggccggggggcgggcacggagggggtggggcagggtcgtgcgcgggtagcagggagggcgtgggtgaggcagaggctgtgtcagcaagcgtaggggacgcggcggggtgcggggggcaggtctgggatgcagtgttgcggggagagtgggggtgcacccgttgggtggcaggcgtgtagggatgggggcgagtgccgaccctgccatccgttctgagcagtggctgctgcctgagttagaggccaataggccgcccgcatcagcggacgcggatcctacccctctgtggatttgaattcactagttctctctgcagcactcccagagcttcacgtttgatgatgcccaacaggaggaccggaaggtgggtgctggcccaaggggtaaaggggcagggacgggtggccccaggaagaagggcctggtggagccgctcttctccctgcccacagagactggcggagctgctggtctccgtcctggaacagggcttgccaccctcccaccgtgtcatctggctgcagagtgtccgaatcctgtcccgggaccgcaactgcctggacccgttcaccagccgccagagcctgcaggcactagcctgctatgctgacatctctgtctctgaggggtccgtcccagagtccgcagacatggatgttgtactggagtccctcaagtgcctgtgcaacctcgtgctcagcagccctgtggcacagatgctggcagcagaggcccgcctagtggtgaagctcacagagcgtgtggggctgtaccgtgagaggagcttcccccacgatgtccagttctttgacttgcggctcctcttcctgctaacggcactccgcaccgatgtgcgccagcagctgtttcaggagctgaaaggagtgcgcctgctaactgacacactggagctgacgctgggggtgactcctgaagggaaccccccacccacgctccttccttcccaagagactgagcgggccatggagatcctcaaagtgctcttcaacatcaccctggactccatcaagggggaggtggacgaggtgagcactgaccttaacccatggatgggtctcaactcagctccaacatttcctggacctgcttcctactgggtaccttcaggtttctgggtgtcagacatggagaggacaggacctcccagcctgttgggacaaggccaaggagatgccagttctgggctgggacctcaggaaaggcttctgagggaagtagaggccccttctggctcttgctgcctggcaggagggctgtgtggtgtctggggagactgtaagagatcctccaccatgaggctgtgagtggggctgagacagagtgtgacttcatccctaaggtatgtgttagcattcctaatcagggaagtgctcttagaagaatactcatggagtttttaggaagacagcagtggtcatcttttgcccccagcactacccagagtcacctaggaagaccccaggggaccaggtatgcagtacaggaggtgcacagtcattgccacacagtcctggagtgcaacagacagtggagcctcagcaggcagcagtgggatgagtggggctcctcacaggaacccttctttctttggtcaggaagacgctgccctttaccgacacctggggacccttctccggcactgtgtgatgatcgctactgctggagaccgcacagaggagttccacgggtgagaatggggctttttctgggagggaagtgtgcccacatgtctagatggtcgtcctcaaccccggctctgaaccagaaccacctgagagcccaggccccaccctagagagtctgacgttgtctgggtgagtgagactggacatagccatgaatttgggggcaggaatgtgccaactgggccttgggtagtggcaacagtatggtacttactagggcacattggttccttgtccccgtttttggtctacctgcccctaggctggtctgggtttccagagatggtctggcgctttggctcagacagggtcggggaggcagtgtgtctcagtgcccccacttccccaggggaccccactgtacagctgagtggcagtgcctctcagatcagtccctgcccttggctttggtccctagcgctgcccctttgggactcagatgccagctcatgtaatgtgtggttcagcggagtcacaaagattgcacctgtgctcagggattagccctgttgaaacccctacctccatctgtccccagccacgcagtgaacctcctggggaacttgcccctcaagtgtctggatgttctcctcaccctggagccacatggagactccacggagttcatgggagtgaatatggatgtgattcgtgccctcctcatcttcctagagaagcgtttgcacaaggtaggctggggatggctgtgcaggctcccccagtggctctggcactggttctcctgcacagatgtggtcagtgcttccacactgtccacactggtacgtggagattgtcttggtggtgtgatatgggcgactcttccggttgttctgtggtccagcctggcaagaagccagacccttcctccatgagaagcatgtggacaccttccacacacttgaaggtttcacttcttaaatctttggggatctttactgagtggtccagagaagccccccagtccctacttttaagtcttaaacacaggcagcccttgattacaagcatagttgtccctcagcatcctgaggagacccataggaacctcagatcaaagcttccttctgattgctgtgactgcactacagggcatctggacagctggggctctaaccatcttccaggagcttgcagaaagcaggctggagtacaataaaccgagatttagtagacctcctgggaatctacctgcctaagcaagggacacacaaggtgcctgcgagccagtcaggatagggagctggcactggacacacagctagggggttgtctgtgcccgtcgctgccactgctggtgctggggtccaggcacattatgctaggagggtcaagaactccctgctctgtccacgaagtacacagagcggggattcggttctcgtttctttttgccaccaacatctgagggcaatgtgtgtgcgagtctaaagctttaattgctttgtgttttcttcccagctctggtttatagttgaagtaattagacttaaagcagttatttctcccaagtcacaaagcttacgagtacctctgagttacgctctatccctgtccttttcaaaagtgacacagacacccaccacccactcttggccttctgctgactaactgcagaggggcctcttcccaaacctctgccgccaggaccagctgttgtgtatgttggtgggaaggggtggtggggaggtgtaactctgtgccagtcacaagttaggcaggggcatagccccagtgacagagaatcctctacagacacacaggctgaaggagagtgtagctcccgtgctgagcgtgctgactgaatgtgcccggatgcaccgcccagccaggaagttcctgaaggcccaggtataaggctgaggagctggtgctcctgggggatgtggtttcggccctgatcacagacccttggctgctctaagcccaagcttagggatggccacctccccaggtgctgccccctctgcgggatgtgaggacacggcctgaggttggggagatgctgcggaacaagcttgtccgcctcatgacacacctggacacagatgtgaagagggtggctgccgagttcttgtttgtcctgtgctctgagagtggtgagttatggagacccaggtcccagcccaccccacctcagccaggcttgcacactgacctctgccttgcccctcagtgccccgattcatcaagtacacaggctatgggaatgctgctggccttctggctgccaggggcctcatggcaggaggccggcccgagggccagtactcagaggatgaggacacagacacagatgagtacaaggaagccaaagccaggtgtgtacccccaacacaccctcgggtctccactcacagccccatagtccctgcttccacacccatgtggacccctgtagggtgggacaggatgacaaatgggcaagagcttccagaatcaagcacctgttcctaagtgctatctgggataccagaaggtggcagatggcaggagctggttacctgtgccgcttctggagggaggcctcttcctgcagttgccttgcccacctcaccccactgggaaaataggtggcttgcctcctgtcctggagagtcactaatgcattccccacattccacccactgggaaacagcataaaccctgtgaccgggagggtggaggagaagccgcctaaccctatggagggcatgacagaggagcagaaggagcacgaggccatgaagctggtgaccatgtttgacaagctctccaggtgtgtggcatgaggaggaggggcctgcagctgggagaagggagagctgacccacatcctgtcttgtgagccccaggaggtaggatcagaggagagcttaggatcctggtattaggttgcattgctcacgtttgaaatcacttgccctggaggaaatcccccaggggatgggtatattgagatcagtattgtgccccttttacagatgataactgaggcccagagaaattaagagactgtctaaggccgggcgtggtagctcacgcctataatcccagcactttgggagactgaggcaggtagatcacaaggtcaggagatcgagaccatcctggccaacatggtgaaaccccatctctgctaaaatacaaaaaaaaagttagctgggcgtggtggtgggcgcctgtagtcccagctgctcgggaggttgaggcaggggaatcacttgaacccaggaggcagagcttgcagtgagctgacattgtgccaccgcactccagcctggcaacagagtgagacttcgtctcaaaaaaaaaaaagagactaatgtcgccagatttattggagatggcccagtgtccaaattaagagcctgcttaaggccaatttagatgtttaaaataggaaactgcttaaagccaggaggcagcagttagggtttgggcccagttaacagaaggtccaaccaggcttccccagtaaatgggagcagcctacttggtagagaggaaggtagcagccacgggtgagtaggacccctgcctggccaactgggccccttccccagccccactgcacctttccccaacaggaacagagtcatccagccaatggggatgagtccccggggtcatcttacgtccctgcaggatgccatgtgcgagactatggagcagcagctctcctcggaccctgactcggaccctgactgaggatggcagctcttctgctcccccatcaggactggtgctgcttccagagacttccttggggttgcaacctggggaagccacatcccactggatccacacccgcccccacttctccatcttagaaaccccttctcttgactcccgttctgttcatgatttgcctctggtccagtttctcatctctggactgcaacggtcttcttgtgctagaactcaggctcagcctcgaattccacagacgaagtactttcttttgtctgcgccaagaggaatgtgttcagaagctgctgcctgagggcagggcctacctgggcacacagaagagcatatgggagggcaggggtttgggtgtgggtgcacacaaagcaagcaccatctgggattggcacactggcagagccagtgtgttggggtatgtgctgcacttcccagggagaaaacctgtcagaactttccatacgagtatatcagaacacacccttccaaggtatgtatgctctgttgttcctgtcctgtcttcactgagcgcagggctggaggcctcttagacattctccttggtcctcgttcagctgcccactgtagtatccacagtgcccgagttctcgctggttttggcaattaaacctccttcctactggtttagactacacttacaacaaggaaaatgcccctcgtgtgaccatagattgagatttataccacataccacacatagccacagaaacatcatcttgaaataaagaagagttttggacaaaaatgtatgtgtaaattatcaaataaaggggccaggcacagtggctcatgcctgtaatcccagcactttgggaggccgaggtgggtggatcacttgaagccaggagttcgagaccagcctggccaacatagcaaaaccttgtctctattacaaatatgcccatgtgctaggtgtggtgggacacacctgtaatcccagctacccaggagaatcgcttaaacccgggaggcggaagttgcagtgagctgagatcataacaccgcactccaccctgagtgacagggcaagactcaaaaaataaaaaaggaacattaactagggttagaaactaacttcattctttttagaattcaacagttttcctaggtcaccaattccaccttttgttcttattaaggcgcaaagtcacaggacccccttcctgggagtcactgtcattaaatctattgccgtcagctcagcccagggtaggcaaggttcaagaatgggaagtgcttttgtctggggaaacacgcaggtaatgtgatgctaggaaggaggatgtgcaggtgggtgagagcccaggagggagcagctggtgcctgacagggtgagccatcagggctgggcctgggtacagccccaggagaaggagcctgtgcagaagtagcagttcagtggattccacctcctatgtcacaatccagcaggtggccaggactcagcctgggttttaagtgagtaatgccttccctgtctcagagattagctctaacagtgtcactagaggaagccctggcgagggtgggggggcgtagtgtggggacaaggaggccagatagaaagtgctggaatgttctggaacagatctgtttctggaggagaggctgagtatggagagtcaacagaatgtgaccaccttcagagggaggagctgggccgtctccaataaatccagggacaaatgccttcagtcctcagactgttccaatagaggggacgccacgtatcccagggttccctttccaactcatgtcaacacctgcagtccctttgaggagactaaatgtatttcatgctggaaagaacagattttctctcattaaaaatagccccactaaaggagaccaacatgctagaagtgcggcaccagggcctcaagactacacttcggaacatgaagagggctggggaccgctcggcccaagtctggatcttgtaaccaacagatgccgagcttgccgttcaactaggcacagaaagcagactcggtctgggattccagttggtctgattcagttcaagagggtcacagtcagaagaaagctttttccattaggagcttcagcagagtgaagagttcaacacagcaaacaggcaggcagctcctttgtatatgtgacggggtggccctgactgtaaacacagccctaccagtcactgcagctcatggcctgagaagacattccagtggcagcctcgggtgtccactcagttcacatattctggtttcacctgcccaagctgtcttcaggcatgaggtcttgtcagaattgggatgtggatgtctcctatgttaccatttattgtgtgggggcagccatcatcctatttgtctggtccatcaagctggaatacagaagacagagggtatcagctatctgtttacacacccaggcaggccagcagatctctgttcaaacagctctagctgcagacatgcaaaatatttcacaaaacaagctgctttctgcaaatactgctgctgctgtgctgggctaagaggatcccagcaggcctgggcagaacagggtggctaaatggagagcctcattctatgggtcttaaagtacccaaatcaatatgtactgatgctcatgtgcttaaaagcattcactatttggaaaagtaaccccttggatagtaatgctgtaaaaaacagaaaatgaaatcataacccattttacatacatttctctgaaactagattatacagttcaaatcctattaagccacttccaaaactccacaggagctaccagagttacaatctgcttttctatgaaaacaggaagttgggccgggcctgctggctcatgcctataatcccagcactttgggaggctgaggcaggtggatcacccgaggtcaggagtttgagaccagcctgactaacatgatgaaatcccatctctaataaaagtacagaaattagccaggcatggtggcacatgcctgtaatcccagctgctcaggaggctgaggcaggagaatcacttgaacccaggaggcagggctgcagtgagccaaaatcgtgccattgcactccagcttgggcaacaagagtgaaactccattacaaaaaaaagaaaatatgaagttggagcaggaaaaggatccctcaaaaaagcctgctgggctgatctaagatctccgctgccttgtgagctggccaggaggcactcgcctctcagcgtttaagcctcattgttagctgggttccctgcctccataatgaagtgaccatgattggtaaaaaatcagcctgcaaccagaggttggaggtcttggactggtggaggtgaggagagtgctgaccccatggccctgagccatgaggcagccacagctgtggacaaggaaaaaggatcaggatttcctaagacatctgccttggaaggcaagaggagcatcaactgtgatatattgtagttgatatggtttggctgtgtccccacccaaatctcaccttgaattgtaatcatccccatgtgtcaagggtggggccaagtggaagtaactgaatcatgggggcgggtctttcccacactcttcttctgatagtgaataagtctcacaagatctgatagttttataaagggcagttcccccgcacacgtcctcttgcctgccaccttgtaagacagtactttgctcctgctttgccttccactatgattgtgaggcccccacagccatatggaactgtgagtccattaaacctctttcctttataaattacccagtctcaggtatgcctttatgagcagccagagaacagactaatacactggtgaaatcccctttggacagtgttacacctgcctgtaatcatgacactggactttaaatgcttaatgctaccacctcccattgaaaacccttaatatcaaggctacacatgctacatgattcttatgggaaactgcattttctgtaacttcacttgtttataggcggtttgaaatctcttagaaagcatcaaggctctttggctttcctcagcggattataattgatcaatggctctcataccaattacttccgaaaagcatcactcatgtagccttcatcccacatagatgcagagaactttagcttctcaaagttctttaacccgtatcatcttagaatcacataccaggccttagagggacactgttggctgctttattttagggagtgaaggtaacgcctatagtctgttaagaatacagactcatcagccctgagtgtctggaccgtgtccctgcttggcctgttagcatctgtttcctcatctctaaatggaggtattgaaagtaacacccagtcaggtccaggtagtgcctggtgcaggattcacagcatcatcagctattactgttactgtgttaaccaacggggctccatatcaggtggaccataccctagagcagtgagaagggcagccccttggatggtcctcctcagcagtctgtaccttcccagtttcccgctgcacaaggtcccgcatctcttctgtccagcccagaagctccactaggctttccacgccgtgaaccacgtcccccagctgggccacgtccctgctgcgaggatgccaagccaagggccccaccaagtcccggttgatgagcagtcggggaactgagctccgcacggcctcggtcaagctggcaaaaggctccacctgaaaaatgggccaaacgtgaggggcacagtgtccactttacaagctcctcaggatgtttcatgccacagccaccgaggccttggaggagcagcagattggcagtcagagcctgcgatatagggaaaacccaccaccaatctcatttcttcagctgagctcctgccgcttggcctccgtgacggttttctcccctccgcctctctctctctctcccacttcttgctgtttccacacatccttgcttttccccacctccgttccaaggctcatcagggatccaaccttcctgcctcctctttgtgagcacgttctgttctccctgtcctccccacctcgctgtctcccagcatgacgcagagggacaacagcacagactcgtccatctcctctggctagccctgcttgctctgacagccaccaccagcatcgggcacccagacgagctggtgcccccgagcaggagttactgttacgtctctccatggtcttccccacccagcctctagagaggcctagctcggtgccatcaggcttcttcatacagctctcaaagcttcttttaagaggaacaaggtaaaaaaatggatacattaataaatggcattaaaactggctcattatctgggaggaaaatactccattcctacctcccactgaaaaaaattcaaatggattaaaggtttcaatgtaaacaaaacagttcttgaagaaaactaaggatttacaagtaaggatagggaagaacgttctaggcgtaaaaactgaagtcagataaggcaaaggaaaatgacagatctgactatgtaaatactattatctcggtatctacataaaactactatgtagaaaatttaaaatttttaaaaacctctcatcatcataaactgcaaaaatatttacaacatatgacaatagtttatattgctaattgataaactcatttataaacatataatttatgaactaatttataatgctaatttataatgaaatttatattaacagctgggcatggtggttcacacctataatcccagcactttgggaggccgaggcgggcagatcagctgaggtcaggagttcaagaccagcctggccaacatagtgaaaccacgtctctactaaaaatacaaaacttagctgggcgtggtggcacgcacctataatccgagctactcgggaggttgaggcaggagaatggcttgagcctgggaggtggaggttgcagtgagccgagatcgcgccactgaacctccagcctgggagacagagcaagactctgtctcaaaaaaaaaaaaaaaaaaaagaaagaagtttatattaacattaaaatgtaattatattatttaatttatactaaaattaaaactaatttatattgctaatttataatgacccaatgaaaaatggtcaagaggtacaaatatacaatccaaagagaagaaacacaactggcaataaacatgaaaagatgaacttcattctttactacagaaaggcaaaatccgcacccccctccacacacacacatgcattttttaaccaatttgatttgtgtgattttggttttggtgaggatgtgataaaatggctacataaaaacacagtttgtggcagtgtaattgttacatctttctggaaggcaagttctcaatatttatcagcatttacccttcaggagttcttgcatgggtagataaggatgatacacagggatattcaccacagcatttacccttcaggagtacttgcatgggtagataaggatgacacacagggatattcaccggaaggcaagttctcagtatttatcagcatttacccttccagagtacttgcatgggtagataaggatgatacacagggatattcactacagcatttacccttcaggagtacttgcatgggtagataaggatgacacacagggatattcaccggaaggcaagttctcagtatttatcagcatttacccttccagagtacttgcatgggtagataaggatgatacacagggatattcactacagcatttacccttcaggagtacttgcatgagtagataaggatgatacacagggatattcactacagcacgggatctcattctgttacccaggctggaatgcagtggcatgatcatagttcactataacctcaaattcctgggctcaagcaatcctccttcctcagcctctcaaatagctgcaactacacagaccatgcctggctatctttttattttttgtagagacgaggtctgactatactgcccaggctggtctcaaatgcctagcttcaggcaatcttcctgccttggcctcccagagtgctgggataacaggtgtgagccacggtgcctggcccagcattacttttaatgtaaaaattatatactatttattatcattgtccatcagtaagaaattgcttacataaattttgtattaaatccacaaaatctatgttaaagctcttgtggctgaatatgtttcagaatttttgagattttagaaaagatcatatggtttacatcccacgttatgtcacacctaaaggggatctggagtggtactccacagtcaaacacattaacatttcgtccacaaagcacatgagatagagtctgtgcgtgacaccagctcattcagttcatgatggcaccagccttacagacatgggtttctcagttgggacctcatatccgtgtaagggaaactgttggcattaacaacgcagcacatctccatggactcacattgttacgtgaaaacagcaggctgcagaatagaatgtacagtgctgtccaacttttagtttaaaattaccatctgtacgtatgcatttgtacaaaaaaaagaaagctgagaggacacagaataaaatgctaacagttggtgggattaaaaagttgatcctttgctttatatctttatataatgtacgaatcttttcaaagacacacatgatacacttataatcaggaaaaaggccattttcatttcacttcaacaataaagatggctggtggcccaagtgtccacacctggtggccagcacggtcagctggtctcagcccacactgtgctgaccaccatggcccctctgactgctcctcctgtgtctgtccctccatcctaggcctagcatggcattctcatgtctgtccacaccctgggctctcctgtctgctcactccagcaccccagctcctgcctctgggccttcctggactccagactcatgtccacctgctcaacacctccagtccgcagcacatcctcaaatccgtggaaacaaggctgagttcctgagctcccccaaacccacctaccaggcttctccatctcaggaagcggcggctccgtctttccagctgctccagccacagccctggggtccttgggaatccacggcctcccatgcactgtgccagcgtacccactctgcgttcacacacacccagactccagcacccctcagcctctgctggctttacctggcccccagccagtgccagccggtgattacctacaagggccctgctgggtctgctgctcccagtcttgcccccatggtgggctcacagcccagcacccaacggagtcctctcaacttcagactctggcctggaacccaagctgaacccattcaccttctgaggtggcgccagcctcccatgagatgacacttgtgccccaccttcttctctgctccagccccgtggccatcaatgctgacttcgccccaccctccttgctgcttgtcacctgtgcagtgtcccctgccagaccctcctcacctcggtaaactcttagatccaactccacctgcctgacttgacactgcagctggttcccaacccttctagcctttctatcctacttgttatctttctcataacatcaatcatctcctaacaaactatataacttcttacactgacatctgaccgtgtatgtccaaagcactggagcagggcccagcacacaatgaatgcctgaacaaacacatgctctgggcccctgtggctgccctgggcccctctgagcacaggtctttctggcccttctgtcctcggtgcctacatccagtcacgcacacactgacttcatggtctcatttcttgctctcatcacagcttttaggaatttcctgagctgcagacgcagacgcagaacagctgcttgaacacatccagggcatgtttcccgacacctcagacacacacagaaccgagctgggcatcctccctcccaaatcacgcctcaccagcaagtgccctgaccttacagaccaagccagacgcctccttctcacgtccccaaaacatcacagactgcgagtccagtccccctcctcgccatccctcaggcgaccacagctccaccttctccaggaccagcctcctggcactgcttgctccactctccactccccaaaggcctccctgaccccaagggtgcagctacgtccccgggccagtccctgtggatttatcactcctcccactgcagcatcagtattcctgatctgacctgggaggccctgcccctccacctcgcccccacacccccatccttctcccttctcctcacacgtggtgccccacccacacctataccacctccaaagcccagcagcttcccaccttcctgtctcctgcacaggctgctgctccctcagcctggaaccccagctgaatccattcaccttcccaaagtggcaccagccctggaagggcccatgagatgactcctgtacccctcccttcccctgccctccagcctcctccctgcacaggcctgccgacagcccatgagatgactcctgtacccctcccttcccctgccctccagcctcctccctgcacaggcctgccgacagcccatgaggtgactcctgtacccctcccttcccctgccctccagactcctccctgcacaggcctgccgacagcccatgagatgactcctgtacccctcccttcccctgccctccagcctcctccctgcacaggcctgctgacaaacctccagggaggtcccaaggatgagcagcagatctgccatggggaaatcaaccacatgcagcaagaacctctggggcagcggctccccaaagaacacaatgtcgggcttcacaacgccggtgcagaccgggcagcggggaaccctgtctgccatcacgtcagcctggaaaacagagaaaacaggcctgaggaagatgcctgcaacaccctgtaaaaggaaaaggcaacaagttcttattaaagtctcaaacattctcccccaaaaaaggtgagagagggatcatgaacccccatgtacccagcttcaggaattaccagttttcatagctaattgtttcacagccctccggaatctgggaggaggtattggagcctttaaaagcaaatcttggacatcatatgtttcacccataattacttcggcaggcatctagcgtatctaacaccatgctctatccctgggatggcagccagagacatccaggcgctaaggaaacacctggtagaccacaccagtcctcaaacagtagtctgcaggcatttggcctacaccgaacactattcagtcagaaaggtgaaactgtctctggtttgagcttcggtgatcatgccattgcctcagccctgggaggcattcaggtcagcttcactcactggctggcattattaggagtaacaacatctgccaaacactgcttccttactggccaaggtgaagtggacacaacttccctttgcgtcaagattaatataaataaatgccttggagcagatggaaaagggagagagttacagaggaagacacctgactttctaaggtaaacctttacagctaacggggcttgttttaagcaggctcagcccagcaaaaagcaacagatacaaaagacaaaagaaagagacccacgaaagatttcagatattcttggatacacagtaaaactgtattatatttaaattaaaaagaaaaaactgttatcttggaggcatggggtatagcaaaaaaaaaaattaaggaagcaaaaaaaaaagatgaa

SEQ ID NO: 470 - DNA, 30229 bp, Homo sapiens
ggtaagaaaaacttacatcttcgaaataaatgacaaaatacattcctgatgggttaaaaaaataagtttagagaatgaaaccatgaaaatactagatacagatgattatttatacaattttggagtagaggaagatttttctttaaacctgacaccaaagatagaaaaactatgaagaaaaaacttctgctacataaattacacaaaatggaaaactcctagacaacaaccaagaaaaggaattacaatcaaaactagagtatacaacacagtagggggaacaactgcaatatattggacaaaaagtccttaatatgtaaatcacctgtaaatatcaataggaaaagaatgaacatgctagaaaaataggcaaaaggcacaaagcaataatccacaaaacaaggaattagaatggtcaaataacatacgaaaaaatattcaggccgggcgcggtggctcacgcctgtaatcccagcactttgggaggctgaggtggcaggatcatgaggtcaggagatagagaccatcctggctaacacggtgaaaccccgtctctactaaaaatacaaaaaattagccgggcgtgctggcgggcgcctgtggtcccagctactcaggaggctgaggcaggagaatggcgtgaacccgggaggcggagcttgcagtgagcccagagcgcgccactgcactctagcctgggcgacagagcgagactctgtctcaaaaaaaaaaaaaaaatttcaacccgacgcccccaaacaacaaagaaattagaattcacataaaatcctttgttaactaatgtgcaaataatgttaaaagttggcagtgttaactgtgttagtgtagaggggaaaatcacaatcatgtaatacaagtgtaaatcagtacatttctgggcaatagtttgatggaatgtaccaaaagctttaaaaagtgctcattgcttttgaaagaacaagtccattttcagccactccaaaggtaattgtggatgtatgaagggcttttacgacaaagacattcaccagtgttgcttagaacaataaaacactaggaacgacataaatatccaacaatagagaattgtttctcttcctacaatgtaataatacgatggaactcctaaaaaaggatatacagaaatgtatacacttaattatatatacgtatttttgacaaaagattggaaagatatactctaaaatgtcagcagtggttctctctgggtacatgggtgtgtgtgttttttttcagcttctctgcttgtctaaggaaaaaacttgattattttgtaaaaagaataaaagtcatattgaaacacctactgttactggaaacttttcacattgtaaagtgactttctaaagagctgttccacgtctccatctgactacgataaattcagtacatttttctttggctttactgccttagtcctgtttgctagaacagcaatattgggattaagacgctgtttctcacaagtgcctccgcctggcaggctccatttttttctttccatttacttcaaaatcaacaaatcccagttgacttggagcctgaagggacgcaggacaggaagttaacgcgtgggtgaagctgcacagaagtgggtaattcaaaggaaagatgaatgccagccggacagaaggtctgaccacattgtcaaccagaaatgcccaaggggatttccattccaaagaacaaaagcttcttagcaccatggggctctctattattttaagcactgaaatatcactaaggctggagagaaaaaatggatggtggagctagctgcaagcgttaagttttaaagtcagcaaaggatcaatcacctatcaacaaaaaaacaccatcaacaccctttaaatcaccagtgaggcagagaaacaccatctctccacgagtcccacacagccaagtctagcctcccacactggaacagacggatctttcttttgctgagcaccggatgataaacaaggagcactgaacattctacagactcagcatgggggcatcggggacaggaggccgaccagtgaagaaggagaatttccaggactcccttctcaggcccacttgcaggcatacgttcaccaagtaagggagtcggcacaagtgcccttgccattcgccagcattttccccgtttttgcttttgttttgtcagagcaggtagctgaatttgcaggcattaaatacaaaatgaaacactgatgaggctgcctctgcagtcaacaaaacaaaccctgcaaagtttccttcttgttctgtgtggcagtcagcgtgggggctcctcacttccatgccatccctgagtacccacgctcaagtctgggaaactgacctcggctccagaggaggcatggctaaatggtttgggggtgatcctatttctcttgccagtgattggtttaggagcaggcacagtatatcaaatctgaacaggaagtttgctggaagattctaggaaagtttttcttctgctcctaaaaagaaagcaaaaagggccgggcacggtggttcacgcctgtcaccccagcactttgggaggctgaggcaggcggatcaagtgaggtcagaagttcaagaccagcctggacaatatagtgaaaccctgtctctactaaaaatacaaaaatgagctgggcgtggtggcatgtgcctgtaatctcagctactggagaggctgaggcaggagaatcacttgaacctgggaggcggaggttgcaagtgagccgagattgcagcactgcactctagcctgggcgacagagcaagactccgtctcaaaaaacaaataatttttaaaagttaataaaaatactaaaaaaaaaaaaaaaaaagctgagcgtggtggcaggcgcctataatcccagctacttgggaggctgaggaaggagaattgcttgaacccgggaggcagaggttgcagtgagcagagatcatgccagtacactccagccggactgacagagtctcaaaaaaaaaaagcaaaaagaagtcagcatctcctctcctaccagatgggattgtgggagcatgtggccccacctgctcctggcagctctcctgcaaccttgaggggactagttctaggagaggtacccgcagagaacaacagaacgtagaaagagaaaatgtggggagctggtgaatcatctaaccttgaaatctttcccacctatagaatgcctgctctgtgagctaaaagattctataactgttcaaagtagttgggttttctgttatttacagatgaaagaatcataaatcactacattaccagtagaacagaactagtctagatcccctactgctatgtatttaagttctgatatgagaatgtagtctctccgataacaggtaaaagcactggctggggaagacacgtcacgtgaacacagactctacaaaaaaaagacaggcagccctcactctcctttcaccaaagatgcctttagacagaggcttttactggttctggtataattacctgactgaggcagactgcgattctgcaaatagaacttatatcctcccggggcctcggtttcaaaaacaccttctgcaacttccgtcagtggccactccagcttcctggcgttgctgacagcctggctagaagcgagcgtgattccctacaacaaacaacagtacatccaagtacatgatcacaacagatattttacagaacaagacaatgagcccaacccctattgcctactgcctttaggtaaaatcacctaagatttaactggcatccaacattttcttctagtgatttaaaaacaggttttcaatgttttatcccacaaacattcagacctttgtgaataataggacagaaattgaaatgccagtgaagtctgattcatttaacaccaaagataacgtcttctaattctaaagatctagccacagaaatcttgatgttacctgggtctgccagctagctacctatttaaggtgacctgttcttgcttttttaacaaacaaaacaaaaataagcaaactatcaaggtttccttacatttaatcaaagtgcctagaaatgtacacgtgtgctttgagaagaccagccttgtttctggctcggtttattataatggcctctctgcctccagtcttgtaaatccattacccactctgcagccaaagtaaactttccaaaacgcatcctatagtccacccccagactgcagccagccttgttttccctttgctcaaagtccgccaatggctcatttcactcggtgacttacggcctaggaggccccctgcagtcttaccccatggcactgccgaccccatctcttaccacgctcccctctcgttctctattccagccacactggcttccttacacctcctcgaacacgccagatgttacctgacggctcttgccagaatattctctgcctggaacgcgcatcccccagatatccacgtggctaactccctgacctcttttgagtctctgctcaaatgttatctcttcactcacacacacccttggcactctactcaaatttacaaccagccacctacccccagccaaaactctgctagaaaaaaacggtatttaccataaagtcattgccaagcttgtagtctccgacgccataattgtaagtcagttctgcgacaaaatgatcatcctcaggcccaaatcccaccattgttttactccatttcccatcataaggcctagaaaataaaagtaaatgaactcagtgactacagacaagtcagcctcaggccacccccagagaactactgggcacagagagatgagcattcctgtctggtcctaaaagttctcttaaggatgagatgacctcagatggtacagaaagcagctgtgggcagtgctcatgggaccctactacaagctccaaagactatccagcatctacctgaaggaaagatttgttcaccttttctgtaaagcaaggaacagaatcctaaagacagttctccaactgacctgttatttccttgactatcaatcaacaagcatgaaattcctaataggccttggactgttccaacttgtcacggtactaagcttaagagatggacgggcgtggtggctcaggcctgtaatcccagcactttgggaggccgaggcgggaggatcacctgaggtcaggagttcgagaccagcctggccaacatggtgaaaccccgtctctactaaaaatacaaaaattagctgggcatggtggcacatgcccatagtcccacgtactagggaggctgagggaggagaattgcttgaactcagaagacagaggttgcagtgagccaggataatgaccccgcactcccacctgggtgacaaagtgagattctgtctcaaaaaaaaaaagatactggaaagccgctgcttcatctagagcatgtacttatttgcatttgtggcataatatgaaacatatctggtcattgtccctggttcctgtctcagagctcccaaaacctctggaatttcctgataggaatatcttttgttatattcataatgagcccctttcagtcacacctgagtttatgctaatgaagtgacttagagtggggcctctacatagactcaggatggggctggtcaccagaaagacaaatgattagaggactgaactttcagtcccatccaccaacctctgggaaggaaagggatggagactgggctctattaggcttgaacaatgagactcatgagcttctgggatgctgaacgtagggaggtgctggattggagcctgcccagaagagcatggaagctctgccacccactccccatgccctgccctgtgtatctcctctgtccagccatttctgactcgtactctttatgataaaccagtaaatgtaagtaagtgtttccagcgtttcccttagttccatgagccactgtagcagactatcaaacccaaggaagcaggagcgggagccctgacttgtagttggtcatcggaaatcctgaagatccagactgtgaccggcgcctgacgtggcggaaaatcttctgggactgagcccttaacttgcaggatctgacattaactccaggtagagtcagaatcaattaaataacaggacagccggctggtgttagagagctggagaatccctttgtgtcccacaggtgttgtatgagagtgcagagaaatgtgttcccgacgctcctgaagttgcctccctaatttactgccttcttaattaattccactgctttatactcatgagagtgcagagaaacagtatgtgttcccgacgctcctgaagttgcctccctaatttactgcctccttaattaattccactgctttatactcactttgagaaactgtcttctgttatccgggtgtagtcagagcctaaaggagattttaagaaacaaggtatcatacccattacaggcagctttgcagccttcttcaaattcctcatgccgcagaacctggtgtgagatttagaataaattgtgaagtgttgctagtactgctcacagcgtctttagcacagactaaaatgtcaaaacacaaacattatcatttataagctttacttgtaaaagaacaaaagcaaatgagctttacacttctcccaggatagaagcagtggaaggacgaacagcttgacaccaagggtcaggctaccaaatcagttgtgaaatctatttagattggtaagcagtgctatgcagtgggaaaaagtgtggccttcagcattaaagaagtctgatttgggccgggcacagtgactcacgcctataataccagcactttgggagatcaaggtgggtggactgcctgaggtcaggagttcaagatcaacctggcaaacatagtgaaaccccgtctcaactaaaaatacaaaaattagccaggcgtggtggcgtgtgcttgtgatcccagctactcaggaggttgaggcaggagaatcacttggaccatgagatggaggttgcagtgagccgagatcgtgcccctgcactacagcctgggtgacaagagcaaaattccatctcaaattaaaaaaaaaaaaaaaaaaaaaaaaaaaaagatgggcatcgtggctcacgcctgtaatcccagcactttgggaggctgaggtgggcagatcacctgaggtcgggagttcgagaccagcctagccaacacagtgaaaccccatctctactaaaaatataaaaaatacaaaattagccaggcatggtggtgggcgcttgtaatcccagctactcaggaggctgaggtaggagaattgcttgaacacgggaggcagaggttgcaatgagctgagattgcaccattacactccagcctgggtgacaagagcaaaactcaaactcaaaaaaaaaaaaaagtctgatttggaattctgtcatttagtagttgtgtaactctgagcaaattagaatctgagtctcagtctcctaacatgtgatgggaatggatgttatgaaagcatctcacagaaccctgcacacagcgggctctcaacgtgttagctttagccctcctttttgattcccacggctcctgccagttgaagttcccaacgcttcgctcagactattaaaaatcatccttattggccgggcgcggtggctcacgcctgtaatcccagcactttgggaggccgaggtgggtggatcatgaggtcaggagatcgagaccatcctggctaacacagtaaaaccccatctctactaaaaatacaaaaaataagcagggcgtggtggcgggcgcctgtagtaccagctactcgggaggctgaggcaggagaatggtgtgaacccaggaggcggagcttgcagtgagccgagattgcgccactgcactccagcctgggcgaaagagcgagactccgtctcaacataaaaaaaataaaaaataaaaaataaaaaaatccttattgatatccttccttaataacaccaaaaaagcacatgcctaaagcacaaagcactgatcccatcaccaccctgtttaagaacataagtgagctcccatcttactgcagcataaaatccaaattctttagcatagcattcaagatactattagaagcaatgccgacctgtccatcctgatatcccatctccttaacttcaactaagcaacctcaactaaaggcacataaaaccagcggcttcgcaaacatgtgccatctccgcactggctcttcagttttactatgtagctcctcctctcatctacctgtggatatcctatctttagacgtcaactcgaatcctggctaacacggtgaaaccccgtctctactaaaaatatttttaaaaattagccgggtgttgtggtacgcgcctgtggtcccagctactcgggaggctgaggcaggagaatggtgtgaacccgggaggctgagcttacagtgagccgagatcgcgccactgcactccagcctggcgacagagcaagactccacctcaaaaaaaaaaaaaaaaaaaaaagtcaactcgaatacaaggtctacatgaattatttcctcatcacccaggttggaaaaccgctccttcttttgtatttttataatagtggctaacacttatataatctactattaccgatatgttaaatactatacatataataaggtgttgaatcttttttttttttttttttttgagacggagttttgctttcgtcatccaggctggaacacaatggtgcgatctcggctcactgcaacctccgcctcccagatacaggcgattctcttgcctcagcctcccgagtagctgggattacaggcgtgtgccaccatgcccggctaatttttgtatttttagtagagacagggtttcaccatgttggccaggctggtgtccaactcctgacctccagtgatccacccgccttggcctcccaaagtgctgagattacaggcgtgggccaccgcgccggcacgtgtttaatctttgcaacaaccttttgatcgacgaggaaatactaacaagggacagctctgtggtttctgctatcgaaagtttggtggtttttcactatcaaattctgacttccattaccatcatctacgtacaaatccagttccaactcccaccccaacccaggccatgagctctaatggaggatatatatcagggtcatttgcacctttgttgccaaaactcaacgtagtaccctgaaaatagcagatattttaaaaatgacctgacgaattcagatccccgtctattgcaccgtctatacactaaaccgcgctcttgcacctttcaagtcttccttagtggtgtgttccctacctccctggcttatcaaaggaggtccccaaaacccagttccccaaccaactgaatcctgcaaataacagctcctcaggacccgagacagaccgcttctgggtgctgttgaaaagcagatgggttgagagttggagcatatattcagagactgagtatccgaaacggactattcagaccagccttgctagaagcagaactctgaatacgctgattttatctacatcaaaggctccaaaccggaaaacacaaatattaactagaaagcattatataacattttatttaccgtcttttccggtagacggtaagctccacaagggcggggctcaataaacgtttacgagtggcttaaatgaaaggacgtgcgtgggcacaccgcggggactaatcgtgttaggcccttctccaaggcctatgatccccaacggcaactcgccacgctcctgaagctgaacaccgcgcagggcctaaggtcggacaccctccggcttaggttcacgacacacccattttcccctccctccgccagggccggctcgggcgccggttccagcctcgcgcgccagcccctgtcggccccggcctgcaccttcatccccaggacgtcccgatagaaacgcgccgtctggaagcggtttcccactttgaatacgaagtgcagagctctgcgagcagccatgattcccgccgcacgcagccgtcacgcgcaccgtacagcccagtccacgaagggcgccacgggccgtgacgtcactagccgccgacggcgcgctttcgtgacgcagcccgggtctcagggaacatggcggcgctggtgagacccgcgaggtttgtcgtgcgaccgttgctgcaggtggtccaggcttgggaccttgacgcgaggcgctgggtccgggcgctgcggcggagcccagtgaaagtggtgtttccttccggagaggtggtggaacagaagcgcgctcctgggaagcagccccgcaaggcaccatctgaggccagtgcccaggagcaacgagagaaacaaccgctcgaggagtccgcatcccgcgctcccagcacctgggaagagtctgggcttcgctacgataaagcttatcccggggacaggaggctgaggtgatgtggttcttgagcctgtcgaatgttctcgtttcccttcccgtcgcacagcggaaccttaacctccttccgatggaggacttcttccagtacagcccgctggtttttgtattatgcacagagggccgaataagcgtctttggaattagcttctgtttctccttagctctttgttgttgtttttgtttcaccatgttagccaggctgatctggaactcctgacctcaggtgatccgcccgcctcggcctcccaatgtgctgggattacaggcgtgagccaccgcgcccggccctctccgtagctctttatttctgttacaactaagcgtgtctcagtaacaaggatgttgatagttacctgttttttttttttatttccatctacagcagtgtaatgacaatagtaaagtccaggccatttcgggaaaaacaagggaagatcctgctggaaggtcgcaggctcatttcagacgctctcaaggctggagctgtgccaaaaatgttcttctttagccgtctagaatacctaaaggagttgccagtcgataagctgaaaggtgtcagcctcattaaggtgaaatttgaggatatcaaggattggtccgacctcgtaacgccacaaggaataatgggttagtgattacccagtgtatctttttttttttttgtcttgttctgtcacccaggctggagtgcaatggcgcgatctcggcccactgcaacctccgcctctcgggttcaagggattctcttgcctcagcctccgcagtagctgggattacaggcgtctgccaccatgcccgggtgatttttgtatttttagtagaggtggggtttcaccatgttggccaggctgacgtcgaacttgtgacctcaggtgatcctcctgcctcggcctcccaaagtgctgggattacaggcgtgagccaccatgcctggccttacacagtgtatcttaaggtgtggagacctaggattaatttctcatacttgtcttaggacagcagcattgaaatgaaattcaaaatgttacaattagaaaaatataattctcaaacctgtgtatcttagagtattttcaatggaaattgaaacccgtttttcactatcatttgtgttgtggctctttatggtctctaggaagaaccactattcctcaaaccttctattttttagattacttcttcaactttctatgtcagattaaaaattaagaaagcgtttactgaaagattgagcccttcatttttgcaaaacctctgccaatgtggtgataactgtcaataaactgcttattccagaagcagatctaagaagcgaggtacaagccacaatttactgccccgtttagcccaataaacagagaaccttgtcttctagtctgttccttcatttggctgaatctgacttaaccttatgtaactccgatgttgattagcagttacaaagtctttggtctaaatatgagaagataagtttttcatacgtttttgacatgggagttttaagatatgaaaactgaatccttgaactgctgagagaggagattctggggaaccatctcttgtctctgtaacccagtgagtcacagggatctgtgcctctgcactcagagctcttagatcctaggatggggacttggattactaaagtacctagaattactcatgctaagtaaccatattctcactagctacagccctctaatccacacgccatgcttcagtgaaagtgttattcatttttaccgtgcttgtcacttggggcaggtgtgctcacagtggccagcccatcttgaacttgtgcttgtcacttggggcaggtgtgctcacagtggccagcccatcttgaacttgtgcttgtcacttggggcaggtgtgcttacagtggccaacccatcttgaacttcatcatcatacctgctttcatcatttcctggcttatccttatgttactatattttagatttgagggcagggaataagggagaaatggataggaactggcagcacctgtcaggctttagacagacactccccagaatccagcgacataagtagggcctccgtatagtgggttctcatcaccacagacatccaagtagaagtaaaggacttctaaggtcctcagccctactgaatggcttttggccatctgtgactccgaagtggaggctctctcacagcacacagacgcctaatacccttccattgccttcagtggtggataggctttttacctgcaccatcttttagaaagaatcctaaatctttgattgtatcatgtttcagtacaagtactatttcattcatctcctgacttcagtcagtagcccatttattgtagcaatcatatacgacaaaatactagtaagattcaaaaaaactgtacagtcccttgggagcagactacaaagggattgaatatttgataattatacataaagagtttagggtagtgcttggcttaaaaaaaaaagcttactaaaaggttatcattatcacctctaccagtaaacatggtgattcaaaaagaaacttgtggatatgtgatacacccatgtgaataacttcatctataccacagcaatttcatgtactcaaagccatttttaatattgttattagcctttttccaatttttctcttttcccataaattctttccataaaactttagagattaataatgtagagattatataatgtagattattatataatgtatatataattttatcatgtagagatcattaaataaggagagaattttccactaagaaggccacttagggttttcattttcccagatagtcccagaccccattttactcctttgtattagactgaggacagagcggtcgccagtaagtggctgtacccattctaaagctcccaggcttctggacctccagcgtgaggccttggaagtgactcaagcgttcactgcacctacagccccttcgttttgcagagtatgtccctaagacagtgcttctgagccagcgtatttgaaaaaggggttgttactttgatgcattcaagttttgaaattcatattctttttcctaggaatgtagtttgaattttaaaatgagtgataaaggaaagataaatcagtatagcaggctaataattgttttttaaatatttaagcctataaactattttttaaaagcctacctggtaggaagatgggcacaggttgtagaaacaagacagttaaaggagcacaggaattcactgaagaagatcgcagtcagtcagtaaggtgtttagcttctctagtaatcagagaaaaggcaagttaaaataatggcatgctgttttttctatcacattgggacaaatggaaacaaatgatagacccgcttttaagaagggtttgagctggaaaacaggttttgttttgttttgttttttgtttttgagatagtgtctctgttgcccaggccggaatgcagtggcgcgatcttgcctcactgcaacctccacctcctgggttcaagcaattctcttgcctcagcctcctgagtagctgggattacaggcatgcgccaccatgcctggctaatttttgttttttgtttgtttgtttgagacgaagtctcgatctgtcgcccaggcgggagtgtagtggcgtgatctccgctcattgcaaggtccgcctcccgggttcacaccattctcctgcctcagcctcccgagtagctgggactacaggcgcccgtcaccacgcccggctaatttttttgttatttttagtagagacagggtttcaccgtattagccaggatgatcttgatctcctaacctcatgatccgcccacctcagcctcccaacatgctgggattacaggcatgagctaccgtgcctggcctaatttttgtatttttattagagacggggtttcaccatgttgttcaggctggtctcaaactcctgaccttgtgatccgcccacctcagcctcccaaagtgctgggattataggcatgagccactgcgcccagccgaaaacaggtatttatgagttcctgatgtgaataaactgaaagagcctgtgtgaacgttaatagtgcacgcacatcatttgtccatttcactcacaggtatttatgctagagaaatttttagacacatggacagacagtcctacagggatacccattgcagcagcatttgtaacagggaaaaattcaaataatttaacagtccataggggaagagctaaatgaactgtggtacattcatactacaaaatagaggctgggcatggtggctcacaactgtaatcccagcactttgggaggccgaggagggtggatcacctgaggtcaggagttcgagaccagcctggccaacatggcaaaatcccgtctctattaaaaatacaaaaaattagccgggtgtggttgcgggtgcctgtaatcccagctacttgggaggctgagaggcaggagaattgcttaaacccgggaggcagaggttgcagtgagccagcattacaccattgtactccagcctgggcaacagagtgagagagtgggactctgtctcaaaaaaaaatagcctacagcagttaaaggaaaaaagtagcttcaaacatattgacatggtaagttcaagatatattgttgcgtaaataagtcgattacagaataatacagagtatgacacggaatgtaaaacacatttacatatggacaggtgtgcatatatataggtagatgcatagaacaagttctaaaaggatacactccaaaacagaacagttgagggggaggagagtggtactggtagaattttatgttgtttgaattttgccaatcagaatgtattcgtggttttttttttccttttttttctttttgagagggagtctcactgtgtcgcccaggctggagtgcagtggcgtgatcttggctcaccacaacctccacctcccagattcaagcgattctcctgcctcagcctcccaggtagctgggactagaggcatgcgccaccacgcctggctaatctttgtgtttttagtagagacgaggttttgccacgttggccaggctggtctcggactcctgacctcaggtgatccacccgccttggcctcccgaagtgttgggattacaggcatgagccagtacacctggcctgtattcctgtatttttatgtaactaagaccatatcaagattgataagtaaatgaaaagtcagactattccccgtgcccacaccaggcaagtaaaccacctgttttgtttcctcagggatttttgccaagcctgaccatgttaagatgacatatccaaagactcagcttcagcattcactgcctttattattgatttgtgacaatctccgtgaccctgggaacctggggacaattctgagatctgcagctggggcaggctgcagcaaagtgttactcaccaaaggtaaggacatcaaaggccaggcatagtggctcacactcgtaatccagccctttgggaggccgaggcaggagggtcacttgagcccaggagttcaggaccatcctgggcaacatagtgagacctcatctctacaaaaaaaactacaattagctgggtgtggtggggtgtgcctgtactcagtcccagcaacttgggaggctgaggtgggaggattgcttgagcctgggatgtcaaagctcatcacatgtcaagtgagctcatcactgcactccagcctgggcgacagagtgagactccctctcaaaaaaataataaaccaggtggattagttggtctggtctttttttttttttttttttttattaaagagatggggtctcactatgttgcccaggctggtgttgaactggctctgactcaagcagtcctcctgcctcagtctcccaaagtgctggaattataggcatgaacaactatgcccagccaagtcaatcactgttaggtgagctatggctctgggcaggcagacatgcattggatcttgggtctgccttcactagctgtggtccctgagcagtagctggaatgacaggcatgaataaccacgcccagccaagtcgaccattgttaggtgagctagggctctgggcaggcagacacggctttggatgggtctgccttcactagctgtggtccctgagcagtagtccctgaagtgtcagcttcctcgttggtgaactgggaggaataacagaatctccctggtcactgtgaggattaagtgagatgatgcacagaagttacttcataccttacctgcctcacgagtaattcagtcaatgttgattctcttttttaaaaattatgttttttgtagagacggggtcttgctgtgttgcccaggctaatctggaactcctaagctcaagggatcctcctgcctcggcctgtcaaagtgctgagattataggcattagccgccatacccagccatgtttattatcttttaaaattatcatgaaacctgctaggctgttagagaacttcacatcgattatggaaaagaaatagatgccaattttaacacttggtttctggttctttatgtaatgatattgagttcccaaattgctgagtatatgagccactcctgagtcttgacttctgaatcctatgaaaggaatgacgtcagcagctctgaatcctaatgtcattgtgatccgtttcccttagattcccttagcctcagcgtgggtcacatgccccgcacacaaattcgcctcattacatttctgtctcttctcatcagaaatagggattaataggcttggctctaaacagactttcctcacagttggagcacgcctaaaatgtctcttacaccttgggaggtggaggggacagagagtaccattcatcagaaacaccccagccaccattaaaagtaaactaatagtggcacccgttgttgagacttgcctaaattgctgctcgcagctctttctcagtcacgccttgctagaatacgtttctgtgccagtgtgagagctacgtgctggggttctgtgatcagtacccgcttactcgccccattatttagtgctctgatagctgttgtgggatttggaaataaatctaaataatccaagcattgtggttttcacattgatactgatggctggggtgtaagaaatagggaaagaaggtaggaaatacttggtgtggtgcccagtatccaggacatgaggatgacgggaggagtctcgcctttcccctttcccttctcccctccaggcagaggggtcagcctcggccgctcctctcacacgcctgggcctatctctggtttcctgcagggagagggaaagcccgtggctgggggtgcaggcgctgttacatcctctgtgtcttattctccgtttaaaatctggtttgcctggttcgtctatcccgaggtttgacaaatgaacttctaaaataactcgtcaggagaagacttgcgctaacaagctgtgcgggggagggtgggaggccatgcagtcactgcgaggccccaccctcggccactctcccagcccgcccgtggtgaggagccgcccctgggaaaggccaggcgtcgcaggctgctgccggggttgcctcttgcctcattgcctcatctctagagtgttccctgctccggtgcagactgaacgttgaagcccaatgggtcttgatgaaactatagatctgattctgtcactgctttgcttaagatccctcaatggcatgatactgtcttctgataaaatgccaaactcctcagcttcccataggaggcctcctccgtgttggcctgcccacctcccacctcctgtgccactacagccccagcgctgattgaccggctcactgcctgtgccaccacacccccacccgctgattggctggctcacctcctgtgccgccacagcgccaccgctgattggccggctcaccccctgtgccgccacagcaccaccagtgattggcaggctcacctgtgccaccacacccccacccgctgattggccagctcacctcctgtgccaccacacccccccacccgctgattggccacctcaactgtgccaccacacccccaccggctgattggctggctcacctcctgtgccgccacagcgccaccgctgattggccggctcaccccctgtgccgccacagcaccaccagtgattggcaggctcacctgtgccaccacacccccacccgctgattggccagctcacctcctgtgccaccacaccccccccccacccgctgattggccacctcaactgtgccaccacacccccaccggctgattggctggctcacctcctgtgccgccacagcgccaccgctgattggccggctcaccatgcttgcagtccttaggctgcgccactctcccgcttcctctcctagctctgtcctctgcctgggcctttatctcagtgtggtggtcttttagatggttttcctcatcgccctgctttgtccgtgggttttctatgactgtgtgggtgcttcttttacatcagttactgatactgtagccatctgtttaataccaccccactacactgtgcgttccttggggttggggactttcattatctttgcatcttctgcgcagtgtctggcacgtgtgaatgggagatgttgaagggatgcataaaatatcttcagcactagcaggagtgactcctatagtcgctgtgctggatgctgtcagagagaggcagaaggtcccatccctcaagaaagctatcatagaagaactggtttatctcctgatccaaaattgatcagacttactccacagtcccctggtctgggaagatttgtaacatcttgattgtttcctttttattttccaggctgtgtggatgcctgggagcccaaagtgctccgggcgggtatgggcgcacatttccggatgcccattatcaataatctggaatgggaaaccgtgcccaattacctgccccctgacactcgggtctatgtggctgacaactgtggcctttatgcccaggctgagatgtctaataaagctagtgaccatggctgggtgtgtgatcaacgagtgatgaagtttcacaagtatgaggaagaggaagatgtagaaaccggagccagtcaagattggctgcctcatgttgaggttcagagttacgactcggactggacagaggcgccggcagctgtggtgattggcggggagacctacggcgtgagcctggagtccctgcagctggccgagagcactggtggcaagaggctgctgatccccgttgtgcctggtgtggacagcctcaactcggccatggcggcaagcatcctgcttttcgaagggaaaagacagctgcgggggagggcggaggacttgagcagggacaggagttaccactgaggacgcagaagtgacttctgcttgaggacgtctgcagctcctcctacaccagcacactggtgggaggctggcggagtcagtgactatggcccccacgttcaggaggaaggtgtgatgccgtcatacagttacaggaaaaataagaacttcctcagaaagaacaggtccgaattcttcctgtcgcgtcactgattttgaggttcttttttctcttggtgacaataggtgacccacgtggctctgtgtgtttttaaaaattgtccaccaagaagcactttgtgcccagaaagttcctgaagcatcatcctggcagggaggcgcctgctccaccagctggtgggtgtttgtaatcgccaagcaccagctataggtcacagccacatcactcacagctgatcactggttggtggaaaataaactatgagcagcagattacgttagtaagttgttttgtgtcgttggtgtgtcacagtacctgtcacgtttggcctggtaacgaggacgtggctaagggaacaccaggaagctgagggctacgctcatggcatccagcagctctgctctgggctcagatggtctgtctttgagattgttcagggcttcactgagccactgtttatgtatccatagaaacggcttaattcaacaggccatgtcagaccttcttggcacctctgcagatacctttttgaggactttgcagagacggaagtctatgcggaaaactgaatttcaaaatcggcagcctcaccctgcatgtgtcaggaaagtgtcactgtttcctggttccctgtgttagtcctacttacgtctcatcccccaatgtttagaggccaaggttctgagaatgaacgcccacaatacagcggcaggacccttctgttctctcagcccctccagggcccagggcaagctggatctttacctactagcggccaaaccaggatgtagccagggtgtcagggcaagtgctgatggtcatcaatgtatctataaggaactgtggggatggggtgggtgggtggaatatgggactcttaagcactgctggccaggtgcggtggctcacgcctgtaatcccagcacctcgggaggccgggcgcagtggctcacgcctgtaatcccagcacctcgggaggccgggcgcagtggctcacgcctgtaatcccagcactttgggaggccaaggcggcggatcacaaggtcaggagatcgagaccgtcctggctaacacggtgaaatcctgtcttcactaaaaaaatacacaaaattagccaggcgtggtggcaggtgctactcgggaggctgaggcaggagaatggcgtgaacccgggaggcggagcttgcagtgagccgagatcgcgccactgcacgccagcctgggcgacagagcgagactccgtctcaaaaaaaaaaaaaaaagcactgcttttgcagccacacagagttggagttgaagacaacacaggaagcgtttccccacacccctctgcccagcggctcccgtaatggtttggacactgctcactccagggaggtcaagtgtgttgctggtgtgcccaggagaaaccttctttctcttctactcccccaacttcctagtcaaactccctcttcctagtaaaaccaaatgaccaagcatgattcacgtgccaaggggcaggttgggattgctctcccctgggggaggggtgtttgcagggacagtgtcctcccaggctgacatctgaatatttgaacatctgctctggagccccactgtggtctgggcctgcccagagctccacatgaatgggcaatgcaagtgtccccccaacactgctcccaaaggctggtgcagagaggacaggcggaaaggcggcctggagaatgcaaatccatcccactccagtctccccagacacctcaggacagtgctcaagcagcaggagtcacgaaaaggaagctcacatctttccagcctaaaaccaatctcgtgggatttgttccccgggttatactcccactgactcgttacaaaataacagtgaaagaataaaccatgtattaccttgtccttgtttagaaaaagcaatgtaaacactggaaagtaatttttttttttttttttgagacggaatctcactctgtcgcccaggctggagtgcagtggcgcgatctcggctcactgcaagctctgcctcccgggttcccgccattctcctgcctcagcctcccgagtagcacctgccaccaagcctggctaattttgtgtgtttttttagtgaagaaaggatttcaccgtgttagccaggacggtctcgatctcctgaccttgtgatccgccgccttggcctcccaaagtgctgggattacaggcgtgagccactgcgcccggctaattttttgtatttttagtagagacggggtttcaccatgttagccaggatggtcttgatctcctgacctcgtgatccacccgcctcggcctcccaaagtgctgggattacaggcgtgagccacagtgcccggccaacactgacaagtaattctaagcccattttatcctgggtgtgagagggaaaagaaatttacatccctttgctttagagtccgtggcttatatgccacggtgccttcagttcactttatatattcatgggtataatttagtagggacgagggagggtgcaggagggaggcaaattgtcctttcttcagtgaatacaggggaacagatggttgttatttgctgagtgattctggaaaatcactaccttgaattctcagttttgagtctgacatttgttctgtcaccatttccccagtaaacaggaataaaaaacgagccacatttgacaaggaaaacactgcttggccgagagacaaacattgtcaggatgttggccacgctcccgcgcctttgtgtggtggcgtagctgtcacagtggcgtctgccaggaggtggcaggcgacacctccaaaaccaccccagtgctgaagggcggggctgcgattttttcctggatttaaatcgttgaaaagggaggaaaagaggatggagtgaagtctccctccaccagagagcattttgcaagctgtctgtgctccggggtgttaaagccggagacccatccagattgtcccagaccacctcagaagaaagaacccggagtacaggaagacatgggaacaaaaacggaggcgaaagaggacgaacgggaaatagcaggaaagaccgtcacaacttttccctgtgactgcagcctctgagaaaagcaactctgggcaaagcataggtgtccagatgtgcctggagctcacgctgggtgcccaccggctggcccttcggttcctgcttcggggcagagagcgttgaaatcactctcccctcgccccagccgctggctcctggctgggagcctggtcattaaggtccagaggagaaacagacctctggggacctgccgttcacctgggaccttccgctgcttgccccggggttgacagcaaccccagatgtccgcaccagccacgctgggccacacttagccccacttttgccattctaccacgcacagccctcacacacactccccatccaaggttccagggctctgggctgaaaatcaccagctgtactgcagggcctggggctgccctcttgaccaagctacctctccctcaggagcagagctgacaggctcacctgtttttaagaaaacatgttgccaccttaaaaattccatgattgtgtttcctctgttttctttttttttttttagatggggttttgccacgttgcctaggctagtcttgaactcccggcctcaagctatcctcctgcttcagcctcgaaagtgctgggatgccaggcgtgagcccctgcgcccgccatgtttcctgttttcatcagtgcagggagtgcacacatgtaataagctaggagccaagttagtggatgagctggtttattgctcaggatgactgaagtctcaactacggaaccatgttacattcgagcagctgagacagcagctgaagccaggtcctcccgaagcttcaggaagcctgcttgatgctccacggctgagagtgacagagaatccagaatagcttatggatgggtcagttctcgtctcaccacactcccaatatccagcttcctggactgttgtgtagggaagagccacttttttcagttgaagtctgagttcttatgggccatgaccaaggctgctgcttcctcaaaaggcacgaagggggccgcgtgcggtggctcacgcctgtaatcccagcactttgggaggccaaggcgggcggatcacgaggtcaggagtttgagatcagcctggcaaacatggcgacaccctgtctctactaaaaatacaaacattagcccggcgtggtggcgtgtgcctgtagtcccagctacttgggaggctgagacaggagacttgcttgaatgtgggaggcggaggttgcagtgagtcagatcgtgccactgcactccagcctgggtgacaaaagtgaaactcttgtctttaaaaaaaaaaaaaagaaatgcaggaagggaacagggaacaaggctggggagggaggagccgacggctgcagcaagctccggcctcagcctcccttccctgctcctctgagatgccgagggcggggcgtactcactgcaagcctgccaagtaggacctccatgtcctctgacattcgagagatggattttttggccctgagatcacgtctcctactgtgtcgtcattctagcacctgtgggtgacttcctcatgtgagtgaggcataagcacccggaatccggactggaggccgtctctgcctctggattgcacactggcctacagacctggggacagagtctttcacgagttgtgtatcgtttaacagaaacccaacagttccacccaaacctcctgacacattctcgggcttgggaagtgtcccaaagcaccaagggggtgagacacacgccttgaaaaatggcagtaggcatacttacctgtcttcatgcgctcacatacgaggtgtacctagaacgccctcatgttatattcccagcactaatgaagctactggtcaacagctatttgttcccaaagaattttcccttgcgcagccgcagcctggaggaagcagggcgtgtgccctcgtctgctggcggcagcagtgaggggtgtagccaagtgcccacttctctcattcagctgcttcggggcaaactggaaagatcctttgagctcacagccccctgctcagtgctactcctgaacctgcgggcctgtgtgcacagccacccacagcgcgcacaacacatgggcctgcccagggcaacggcaccgtcaacagcgtgtgccctcgctcagggccctgctggtactacgcttcccagtgtgcagggttcccagacgtgtgtcctctcatacattgcatttcctccctaagctgcacggggcaacaccgtgttaggtcccgcgcatctgctcctgggccacatccggctccgtctgtattgttcctgaattcagtttgctgtcctagaacaaggcagcaggaggggagaacagcttttcagtgtctttaattaggcaacaggaaaaaacaaagtctggctgaaaattactatttgaagcttggccgatgccaacacagcactcgctccctgcgttctggtaagtgatggccattgatttcaaggacgtaccaaggggcgaaaagcaagagcaggaagtcacctcgctctggaaaagaagctggttttcatctgctgtatgtgctggtcccaaacatacccttttctctttttttagtattttttttcccaattaggaattcaatgtggaaaacataccctttttcttcaacaggcttttaatgttgggaagacaggttaaaaaaaacaacaacaacaggctggctgtgccggcgcacgcctggaatcccagcactgtgggaggccaaggcaggcagatcacctgaggtcaggagttcgagaccagcctggccaacatggcgaaaccccgtctctactaaaaatacaaaaattagtcaggcgcggtggtgtcgcttgtaatctcagctacttgggagactgaggcaggagaatggcttgaacctgtgagctgggatcgtgccactgcactctagccggggcgacagagcgagactctgtctcaaaaaaaaaaaaaaaaaaaaaccctcatcgctgttgtgaggatgaatggatgggatctggaagtcactgtggtaaacacaaatctgggaaccacagagtggcgttttcacagccgcccccagcctccacctgcagggcctggttttcctggctgccggaggaagcccttgaatatgccacagctggtgctgaacctgcttccaattagcaacaagaatctgaaggtggagctgcttggcggggattatcatgccacccacttcgcctgcatctgtggcctttacgacctctcactatcgatccctgacactcagaagtgattcttccctaacggtttcccgcaaagcagtcactgtataaacctgaacctttggagtaaaccttccccacgggtcttaaggaagctacagacccactctaaaaggggaattctggtgtcaagaatccagttgcaatgacttagggcaaccccctcgctggactttgttcctcctgccccaaaggtaagcagctgctaagagaacccacctttcctccgaggccatcatgatacatggagagaaatcctgccacctcccacattcaggtcggccacattcatcccacccaccccgacccctaagggagactctggcagcgttcccagagaagccttgagcctgggacctgctgggtttaagaggctcccacacttggcccattcttcacaaggagacccgtgcgtgattcctcctgttctcccaaccagctttctcaggcttcagaggactcggctcccctggagggaggaaatgggcaagaatgtccacagcaaggtacgcgatctgaggattcaccctccgtccagggccaagtcaaaccaggagagacggtggccagggctgcaggagggatctgcctctgccacggtcatccaaatgagcttcctggctgccggaagccaagaggatgtgacagatgctacatcctgggggtctcaaaactcctgggactcagctcccagctaccaggtatcctccactgcccaccccgatagagcacaggaccacaagcaaaaacaacttttgtgatcaaggacagcagaggcccagggtggatgaggtccagagatgcctgctttatttcctacggggtgatcgcatttcaggctggtaacatcacataacaagtctaatcgccaactagttgtacgcctctgaactacaagtcaacaatccaattcagcaaggaacaacagtgtcaacagctcattagcgggtggggaccggattttccaaatcaatggtcttggctggcagagtgctgagtggggcctgagtgaatgaggctaaaacgcttggccgaagccgtccatccccaatcctgagaacagagttgtctgtttctctttcgggggtcaggtcagcccaagtaagaggccaacaacctacctgggccgatacaaggcgacacaaggcccacccgtggctgacgcgccctccaccctcactccatcccggggcacagctccttccgctggtgcttaggaaaaggcgaggcttctggtaatttctcatctttgtagttctgctttgaaaagaaaagggggccgggcacggcggctcacgcctgtaatcccagcactttgggaggccgaggcgggtggatcacctgaggtcaggagttcgagaccagcctggccaacatggtgaaaccccatctctactaaaaatacaaaaattagccaggtacggtggcgggtgcctgtaatcccagctactcgggaggctgaggcaggagaatcacttgaaccttgggggcggaggttgaagtgagccaagatggtgccactgcactccagcctgggcgacagagcaagactccatctcaaaaaaaagaaaataaaagggaatggcaggggtgatcgaacgtgggtgtgggcacctcagcagagatcaggggccttgggcacagagctgggtggagcgagaggtccgtgctggtgcagaggtgctcctcctaggactcagggctaagtttcttgggaagatgtccaaagagaaggattcgttaacagaatttcaggatcgtgggagctgtttgtatgatatgaaccattaccttagctacatttttcttctcacccaaaaaacctctacaagcttccttttgcatttggagatcccctgcctgagaacacaagagtgggctgcttttctctcagaccgaggaagactgtgttgcttagaaaaggacgtcctcacccgcagctctaagcggaggccctttctcagctcagcctccacgcaggtgtcacccggcggttcccctctggccgtccggggccgtgtgtgccgacgtcagagtcagagcccgagcgggacccaccggccctccacgctcactctgcccaggacaccctggcagatccttcaccaaaagctagtgactttgcgaaagccatgcagccccgctctggccgggcccccggccatcccgtgctcccaaacagagtctccaaacacggtggactctgccgctgctgattccacaccccagggtgctggctgaggagtttactgcagaaacaaggcaccacagagaggctggacacttgggtggtgggattcggggcacgctgggtaagtccaagggcggaaggaaggagggggaggaggagaaggctgagttttaaataacgtctcaggaggccggagccacgctagatgggctccggtttgagcttctctgctaggaagtcattcacaaaggcctccacgatggcgggggtgatctcctccacgtccatcacgtacttggcccgggctgacatgtccaggatggtgagcaaaggggcagcctcaggcaggttggtgtaatctcgcagggagtcagtcatgtcatcctgaagccgtcaggagggagagaaaaccaagaagttttaaagaaaggagggggagagtcccctgggcccagtctccccaggtgtggtagctcccgcaccctgaagagccggcgtttcccaagcagagggctcccagcctgggaaggagggaaccctgccctgccttccggaggaaggggctgctttgtaaaattctctctttgcatccgccctgcaaaccactaggtaagtcgtctgtatttaattatttatgtatttattagcatcaacaccattttaatacgtcctcagcattttagaaatgtcacattcttttttttttttttttttttgagatggagtctcgctctgtcacccaggctggagtgcagtggcacgatctcggctcactgcaagctccacctcccgggtttaagcaattctcctgcctcagcctcctgagtagctgggactacaggcgcccaccacgcccggctaattttttacatttttagtagagacggggtttcaccatgttggtcaggctggtctccaactcctgacctcaggtgatccgcctaccttggcctcccaaagtgctaggattacaggcgtcagccaccgtgccagtctagaaatgtcatagcctctgattgtttatttttgtaaccaactgtcaatgatttgcagccccactgtgggttatctgaggccaatctggacttcaactctggaatgtttttaaacagagacagctcgctgtgttccaactcccacccctgtggtttcaggcaggacaggagctgcacagccagccagttcagaagacagcgctgcttaagcactgtggaagcttacgctgcctcactacttatctgagaaagaagctggcactttatcctacattcccagcagctgtcctggtgaatttccctaatagcagacatagcctcatgcagacaccaaggcaaacacagaaatccaaagacaaggagaaaggatttgtaagggagctactttttttttttggagatagagtctctttctgttgccccagctggagtgaagtggcgcagtcatagctcactgcagcctccacctcctgggctcaagcaatcctcccacctcagcctcctgagtagctgggactctagccatgcagcaccatgcctggctaatttttgtacattttttggagacacaaaagtccagcccagccagacgggagccagcaaactgccttggagcagcccctcgtccactctgaaccttgcctccctcccctgtgaaacaggacagcgactacgttcccagccagagagccaggagcgaaggagacagcccaggtgaaatatgcggctctgtgcctggcgtacagaaaacctgcaaat

SEQ ID NO: 471 - DNA, 263612 bp, Homo sapiens
attgatttgcacagaaattcagagttagaaatgtccattacagtgttgtttactttttttttttttttttttttttgagacagagtctcgctctgccacccaggctggagtgcagtggagcaatctcagctcactacaacatctgcctcctggattaaagcgattctcctgcctcagcctcccgagtagctgggattacaggtgtgcaccaccacgctcagctaatttttgtatttttagtagagacagggtttccccatgttggccaggctggtcttgaactcctgacctcaagtgatctgctggcttcggcctcccaaagtgctgggattacaggcatgagccactgggcccggcctgttgtttacaattttaaaaatacatttaattttcataaattgtgtgtaagtagattacatgtttgagaagacagattctatgccacattaaaagttagagccagaaagtttaacttcatgataaaatgttaccaaattaaaccagaatagacaagaatacataacagggttactggctagtgggattatgatagtacttaatggtagaaaatcttgttttctaaattttctgccatgtattaggattagatttgtaatataaaaaataaaatggccttcaatttgcaatgcattatatgcattttttatccaaggagaagtatttaatgaccagccatagcaaatcatattatataaggtctgcaagatacctatgtattgtgaagttatagtcctattgcctcaaaaagcttaccacaaaaagtcctgtatttgcgatgttcctttttcaccaaaataagtattttgcactttacccctattatcatcaagcagactcatttcccccaccctcctgcttcctcaaatcagtttctagctggctgcctagagttcaaaacccctaaccagtccctaagctttgaatttgcactttttctattccatgtaacatgtgacaaaccattactcagttgaacactttccagaaaaaagtcagttaaaagaagaaagtcttcctggctggcctagggaaaaaaaaagtaaggaagccttttaacttgcttacttttctacctcaattctctttatttagacactgtttagaattaaaggatgagtttaggattgggaaaaaaagctattatctcaaagcctggttgttcttttctttcttttttgagatggagtctcaccctgttgcccaggctggagtacagtgacgtgatcttggctcactgcaatctccatctcctgggctcaagcaattctccttcctcagcctcctgagtagctgggattacaggcctgcgccaccacgcctgactaatttttgtatttttagtagagacggggtttcaccatgttggccaggctggtctcgaactcctgacctcaggtgatccacccgcttcggcctcccaaagtgctgggactacaggcgtgagccaccgcgcctgccctggttgttcttatcctctttctagcccttttctctaccctcaagaatattataaaatgatgtgcgaaactgcctatcgggatagagtgcataggaagtaaaaaactattcctacagactcaaaatgaaaaatatttttatttgccaacatagttcttcaaatctaacactatcaagttggtaccacacttggggcaataagggaaggagacccctatctgcaattatacctttcatttggtttttacatctacctcgtttggctaccacaataaacctctgaggtagctggactatcactagcttcctgataaattcttcctatgaaacagcatcgcttctcctgttcaaacatcagaggcagcagcagctgccatactcatccacgtaggaaacagcattggcctctttatgagtaaaactttgttcagggctttagatttagtagttgccaggggagaataactgtgaacattcatgttgataaaccagatttaaaaaaggaaattgctttctcagagaccattcagaaagaaagaggatactgcctgatttcttatgaagtatttaggtgattaaaggtgatacaggggactgatcactccttatctctaaaaatacttcctttacttggcttgtgggacaacacactcttcagtttcctcacaccccactgtccacttttcaatcctcctcgatggcgccttctcttttgctcagctttccatgtggaaagtaccaattctcaattcttggatctcttctcagtctaactccctagccaagagatccctttaagtctactggtgatgcttaacatttaactatcctcagtccaaacctctcctctgaatgcttgacttacatatctaactgcctacctgatgtgtccacttgggcgtttaacagacacttcaaacttaacatatccaaaacatttgactctctaaagccagaaactagtaactttcactattgccactactgtcgctctagtctaagccattaatgtctcttaaaccagatcattccaatcatttcctagcttatctcatggttcccagtgttttaaagaattcccagagccattctttaaaaatataacccaattttttggctttgctcaaaatcctccaatgaatgctcatagcacttaaaatcaatgaataaaatctctatgcaacctcatttcctcctataagcaccttttcctcactcaccttcagccacagtgttctccaaattcacttatcccattcctgcctcagaaccaccgcacctgagtagaatactctccactcagatacctacaagatgcttccttacctaatgcaagttctctgctaaatgtcacctcagaaagagggattccctaaccactctaagatagttctcaaggtgtagcatagtggataaagaggctatttttttgtgtcatagaggggacacaaaatatgtatttatatttgcttgaggtgaagaaaaattcatggccaggcgtggtggttcatgcctgtaatactagaactttgggaggctgaggaaagaggatcacttaagctcaggaattcaagaccagccttggcaacatagtgagacctcatctctacaaaaaattagctgggcatggtggcgcacacttgtagtcccagctactcaacaggctgaggtgggagtattgcttaagcccagcgggtcaaggctgcaatgagctgggatcctgcccctgtaccccatcctgggcgacagaacaagactctgtctcaaaataaataaataaataaataaataaataaataaataaagttcattgaagaatacataagaaataataaaaatagctacttactggattggcaaaagtggtaactcagcagataagatgtagggtgaaaaggtttttcatattatttcttttcaaaatattatttgaaaactacctgaatgaacacttgaaaacaaatgtaaaacagcagtcctctaccactgtctctttaccttgattaatttttcttcatagcatctatccttacttgactttacatcgtaaaagaattatccatatcctccagtatattgtaaacttcatctaattcctttactgctggaggatataatggttttctctttaatttaaaaaacaaaacaaggccaggcgccatggctcacacctgtaatcccagcactttcagaggcctaggcagtggaccatgaggtcaggagatcaagatcatcctggccaacatggtgaaaccctgtctttactaaaatacaaaaaattagccgggcgtgcctgtagtcccggctactcgggaggccgaggcaggggaatagcttgaatccaggaggcagacgttgtagtaagccgagactgagccactgcactccagcctggcgagagagcaagactccgtctcaaaaaaacaaaaacaaaaacaaacaaaaaggccccaaaaacaaacaaacaaaaaaaacccatccgaatggttttcattatttttgtgtcacctttcctcccagcatcttttatttatgtaacattcattctatttataaatgtgcatggctttgtccttggctatattaagtatatggccaggatggagacataagagtttggcttgttgaatttataaatgtcaaaaagccaggaaggaaagctaatcccttggatgacagaatcatgattcaagaagatctcaagttttaactatagctacgttcacggagatgaaatttaataggaggcaatggtaaaatactggtttaaaaacatcacctgtgtgtttatacacaatgggagaaatctagctaagtgtaaaaatgttggtttatgttgactacatcagtggtttccagaccaatttttcagaaaacaaattaagaatcaacataaggctgccaactttttattggttaatcaggaacactaaaataaaacaaaaccccatgaccaacatcaaaagaaacttaacctatcattacttaataggtgttactaacactatcatttaataaaggccatttatgaacattagaaaaggagagcaaaatctcaaaaaatagtaccttgaattacataaatataacttgaaaagccatgtaacatttctctctctctctctgctttttgctttgaattagcagagatgactgttgttaaagagttgatacaattttagactttaaacacaagtgtatggcttgaaataaggaaagggacaatttcactgcactttgcattcagaccataactgcagaattaaatatggaaacaagatcagaacacaaagaatagcactgacaaaactgattgaatccagctgagagatgtgagggatggcaaaggaaaccatatgaagttggaggtgtcctaacatttagacaagagaaaatctagctaatatattgagaaaaaccttacttcatcttactcctaaagactgaattgcaaccagtgggaagaagttatatagtaaaagcagctactagctcaatttaagtgagatcttcctattacactttttggaagctaaacaggctttcctatgcccagggaagggtttgtggagaagttggacccaataacatctcagagatattagtagtgggtgatacattgtatgagctgacttctaaagttcccttgaattctaaaattttatgaaccagagtaaggaaataagtggtaccctttaacttactaaaaaagatgagtagaaagaattttggctttagccaaaaagacaaaggttcaattataggccctatcacttaggaatgtgtaacgcagaggcaaagttattcactaactctatgcttcaaattttttcaatgtgtaaaaataataccttaatttagaagtttgttgcagaaattaaatacacacacaccacacacacataaacttcctggcacctaggaaatgttcaaaatttggtaggtattattcaacgattcaataaatattgtgtttcaaagggtaatattttctatatcatttattacttatggatatacttaaaaaatgacttgttctctgctatgtgtcatttgtttttcagacctcaacaatgcatgcttgggattcttttccacttctatactttctgcaattcctgtttgtatgtaagtagattttatgaggttttctttaactttgcttttgctgttttgtttttccacctttatttgatataaaagtgggctttaacagcaacacacattggctatgtcactggctttggctaaaacatttctgctaaactggacaatatatccagtttaatcaaccacactaccagacagatgttttttatctctcacaatggctaactcactgctgaacactcctttatgaaatttttgagtaagtaaataaaaacctagggtatctgattagaaattttggttattaatgaaataaagatatttcttcccatcaaaagtatcccatttcttaatgaaacagatcaacactgaatgctccagtcaatactatctactcaccaagcattcttcaaatggcacgtaactgctcttttgttatacttccagaataatttgcaactgtacagatactttagttagcaattaaatatcaggttgtctgtcagatacttagttgaagagtacactgcttaacatcccagtgtttgggacagataagaaagaaaagtctttacctattaattagtatagaaaaaatatttttcaggaatacaattttgtggaataaaaaacattttgacaaaaaagcttaagcatatacaatatttagtactagatgagcattatctaattgcaatcagatacaataataaaactagttctttttttcagtagataaaaaggaacaagaaactgatacttggaacaaatcaaataaatcacgaagcacagaattttaaaaagtaccataacagcattaatatgcagaatgtatgctaaggtttacagtataaatttcactattctaatgttaaaatagggaacaggcagattatttccatacaaaataatctcagaacacaatgaaatttaccagtaaaatacatttaaagcatgattgaatataatcccacatactgaaatttagttacagatttttaaagttgaaatttaagataaataataaatcctttaaagaagtctattaaaatgcaacgtaaaattaaacgattaaaattataagggaagaaaaaagcactttatggcaaaatcaacccaataaaaaacataaagttaatatatcttaaaatgtaaattctagtttaagttaaaagtaatcactaataactcattaatgattacaactcattaactgtggcaaaataaacatcataggttcttgttatgcggaaattttatttttaacacagcctatagagttgatcatcatactattataaaatactattgattttcaagaaataatattaaaacctaccgttaagtagctaccattaggtagtagggaaaacactgcaacacttcgtttttatgaaaagcacatgttaggacatctttcctcatgtagtaagttactttatgaaagtaaaggtccattttaggaggattactacttttacatcacaaaggcaagaactagattaatcacggtgagaatcaagttcagtgatagtcacagcctactcagggagcacatagagaagctttccatacattttcacaaggtaaaagggctagggggacacaggaaagatcactctgcagaatggaccttgagtttcgtttggctctgccttcgattaactgtctggcttgggcagacaagtcagttaactttctgagttttagtgtcttcctctgtcaagtgcacttgggctcttccgtgttatctacaaagttaggaagagctaaaggcagccctagttttactttttaaaaaataataacagaaaaatacataagttgctattcatcagtgtactgtttccagagctgaattcctaagtctctgaagcatacccagttagggttataccagtgaagatccagatactatagtcataatgtcactctctcctctcccattattcctccacctgctcctccccatcctgctttattctctcttctggtgtgttttaagaagcaacgccagcaaacggctgcatacattgtaagcttaaggattaaatcattttaaaatatgcattttcaatcaaatgtatcatctgcttcgccaaattcctcccaaatggctgaattttcattaagagaataaaaatgagttaacaacttcggtaacagaaatgtactgggccagttgttttgtttgttttacttgcttaaaaaataaacggaaagatgtatccattccctcaggaacataaatgcattacctgcccaatgaaaaaacaattctgcttgttcatttccctgacacaacagcttcgttgtcaggccctctctagcccaggctccaacgtcacctagtaattttatattgatcaccttggcagtgcttggactccagcaggcatagtccctgtcttccttacattcctcaaaataaataaataaataaataaataaataaataaaactctacgaaacaccaccgaacagagattctgtgacttagtatacaaatcccacgtcttcccgccctgtgttaggcagctgcaaatgttattttttcatcgcttgcataaaatggaagcgaaacgtaccaaaaccctacatctgaatcctaggacaatgaagccgacaggaagccactctctcctcccccgggtttactacagagccagagcctccacggggtgcagtcgccaggcagggtgcatgacaccgcgtcttccacgccctcccaacgcgtccaaaaggttgctcgcctgacctcgccaaccgcctcacaccccaaaaccaatcacacaaaagggattggcccggggagctgctccaatgggggaaaaatcccttccccagcggcagcgcagccattccctccaatgctccgcccgcacccctcgcaaactgctacggcggaggggggagggctgcacaaagccagtcgaaagctgaaaatgattcaatgcacttaggggatgcggaggcggcagcaaggggctcgggaaagccggggggccgcaggactggagctccggggggcggcgggtgggggatgggaagggtggtcccgtcaagccccgggtcccaggcgggcagagggtgggggtggcggcgccgcgcggagcacccgggaagcgcccccttcgcggtccagccccgcacccccgccccgcggcgggcggcgcccgagtcctcgccgcaaacccgaggagcaggatgtggaaagcagccgcggcggtggctgcggctgcggcgcctacaccgagcagccgatcgcatcacttaccccttaccgtggagagagggaccggacgggggaggcggggcgcgtcgcgtcccgtgagtctctcgcacgccgtcctccccccacctcgtcgtcgtcgtcgtcgccgctgttgtcgtcgctgccgctgcggtcgagctccggggccctcagctccgctgggcaataacgttattccacacacgccccacacatagcggtaacggcaaagaccgactgcctagtgcgcaggcgcctcgggaaagggcgaggagccggaccctatcccctcctgcccagttccaacgatcccttactgcgcaggcgccacacacagacaatgaaaaggggttgtgcgagggtctcacccacacgcttttccagcttgcccactgcgcaggcgtgccccgaaagaccagcttgaacaatgaagaggacctcggcgttaggtgggaccgcaaccaacaaggactacagttcccagcgggcagagcgccaactccaagtgaaggtccggttgctgggcatgctaggagttgtagtgtcggccgcctttacaatctaggctgtttggaagatttagagcttctatttcttgaagatttattcgaccgttttaaaaaatctcgcaactgaagcagggttcagagtttactatctgcgtccttgagtagcctggggatcaactgctgcatattagcaaatttcgaagcgtcaaggccttcagtgagccctttctgtcatttgggtggtccaggcagctgaagagtgggatggaggcgggactaaaccaggctgggctggaggaaaagggcggggcctgcaagcctgtctcttggcagcaggctctggcagccaaaccgtccaagctagcgcctggagcgcagtggtttctgggaattgtagtgtaactggaaggccctgaggattgtcgagcttgcaggttctgaacgtgaggactacaactcccgacgtgcaaagcgagggccagtgggtgggaagagcccccaagagctctgtgcgggattctaggctcccctgtgacagccgcggcaggaagcaggcgggcgctccccggccacaggcctgttgttctcggaagggagaaagctggacatttccccacgtaactcccagctctgggcctagagtgcgtgcatggcgaagtccccggagaactctaccctggaggagattctggggcagtatcaacggagtctccggggtgagttgctccaaacctctgtccctagccccgaggtgcccagggcctagtgggcgggagcagaccaggtgcgtttcctaacacctgggttctgccccgtccacgctacagaggagcaagatggatgttgctgtggtcttgaggaggatgaaatagtttgatttagtttttacagttaagcaacgatgtttcctcagattcccgtagttacctcaatcaactccttgatcttaacttggcatctttctcaaccggcgacagcagaaactcttggatagctctatgccatttttgttcagttcccatacgttgctatttaatccaataaaagtctgattcacagtttttacacatttaaattatggcacagtggattgaatgtgatttatgggatcagtggggggaaacactaataattattttaatcacaagagcccccttttaattgatttaggctatttacatacagtaaatcatctgcagcttacaccaatcgtgtgaatattttacacatggggaaagcgaagctcagagaggttgaattacaggccagagcccacacagctggttagttgcagagccaggtattatcaggcttgccttcaaagcctatgtttgtatttactaatcaagccataattactattatcaaaaccttattaatttagattttcttaccacattaccatatgagcaagtatctgtacaaataatgtctgtatttattttcctttaagctctgttggacttaatgtctgtacttttagatggcgctgtcaacttggacagcatatataacatctagaaatttcgattctgttataatggaagttatggaattgtccatagggttattgtggggagcaaatgaaataatccccataaagcagtgattttaagacttcttaaaatgtttacctatagtaagaaataaattttatatgggacatatgtgtacatataaactataagtttcactgaagaatttttattctactaaatgtaataaactctgctttctattctgttgcattttcataagcctctaggtcatgactgtttgcgacattgagaatactaagttatgaagcatgtgttgttctgcataatatgcctactatgtgtcagtgcctcctactatgtgttaagcatactaggtgctaggcatgcagtaaggaacaagacaaagttcctatccccatggagcttctggattagttggggagaaagacaaaaaaaaaaaataattatagattactatgatagaaagtaagggtaaagatcagtgcttactagacaagcactcattaaatgttaattgttatttatacttgttacttaaagcaaagtgaaggtttttcaatattagaaagtttatcttctcatgactctagattttataagggttactatgtattgttacatctgtcaattgtgttaacaaactgtcgacattctcagtattcaaactgcaggagtaaaaaaatcggttttaatgaacaccttcctcaacctactgatgtttcaagagctgttagatacaaaataagcacttctaacttttcatttggaagcaagaaaaatactgtgcacaatgatatgagtaattgtaatttttaagattggcaaaaattttttgttttcattgaaagtttttcctgatgcttctcttcctttgaccttattttaagtctttatataattgtcggaggctgtttaacattaggcattttgacgcagtaaaggggttcattttaaattaatgttatagtaatatgtttaatactagtggtactgctttcaataattacagaatgaagggttttcatttaaggataatacattttaaaattagtttgaaataaaatttaaatttagtgtgataacaatataaggtagtggaaacatttcaccaagagcaaatacgaaggatagaaaaagttaaacaacttaaaaaaaaacgtattcataattttaacagtgaatcaggaaatgtaacctgaaatgtttatgggtttttcaggacatatcatttatttagtagcacttttatttttgtatgttagcttatataacagcttctggaaggaaacaaaacagaattaactctgaacttaagtacagtcagaagttcttcacaaatataaattgctatttttgagtagtataatttatttatttagagatggagtctcactctgtcatccaggctgaaatgcagtggtgccatctcggctcactgcagcctctgcctcctggattcaagcaactctccagcctcagcctcccaagtagctgggattacaggcacgcgccaccatgcccggctaatttttgtatttttagtagagactgggtttcgccatgttggtcaggctgctctagaactcctgaccttaagtgatccgcccacttcagcctcccaaagtctggggttataggcgtgagccaccgcgcccggctgataattccctttaaagtaaagtattctgttccttaataaacaatgctggagttatgtggaaattccttattttgagtgtgcctaataatttaagaattgtattactatgtagtaagataaaatgcagtttaaagttctatgtcttattttgttttggttttgttggtttgtttggttttgtctacccaccattacttccccaaatgccttgcgtagtttatgattaatggaagcctaataaacagtcttggtctttcctcaccggtttttcctctagcttgtaaataactgcacatgtagtcactactaatatcccttcattgatattcagccaggaagtggccgcataaaaatgcaaaatgctttccctattttccgtgatcgtacttccattttaaaaagatcttttcctggggccgggcgtggtggctcacgcctgtaatcccagcactttgggaggctggggcgggcggatcacgaggtcaggagatgggagaccagcctggctaacacggtgaaaccccgtctgtactaaaaaaaaaaatacaaaaaactagccgggcgtggtggcgggcgcctgtagtcccagctactcaggaggctgaggcaggagaatggcatgaacccaggaggtggagcttgcagtgagccgagatcgcgccactgcactccagcctgggcgacagagcgagactctgtctcaaaaaacaacaaaaacaaaaacaaaaacaaatttccttatttctttaatgttggtactattatggtatatcaaaatttgaagttctaatgtgaaaactgagtcagcatttactttcttgtttttaaaatgaggttgggcgcggtggctcacgcctgtaatcccagcactttgggaggccgaggcgggcagatcacctgacgtctggagttcgagaacagcctgagcaatatggagaaaccctgtctctactaaaaatacaaaatgagccaggcgtggtggcaggcgcgtgtaaccccagctactcgggaggctgaggcaggagaattgcttgagcctgggaggcgcaggttgcggtgggcggaggttgcagtgtgctgagatcgcgccactgcactccagcctgggtaacaagagtgaaatcctatctccaaaacaaacaaacaaaaaaagatattttcctcatttctttaattttggtactattatggtatatcaataatttgaagttgtaatgtgaaaactgagtcagcgtttactttcttgcttttaaaatgagatccttgcctcattttgaccttgatgatcttggagcagctccacattcacctttcatccattcccttacacttttcagtggatttgctgtttgacttctctaaagatatctcttgctttgggtcgcctatgcccttttacaagaaattggagacatttaatgattcttcttcaaaacgagagttctggcagaaaaaccggaaggctttgttgcccccacagatctgttgtattattcctacatagtaaatggtctgaaagtttccagtgtggttaaaagtgtatgtgtcctgggtatcctgggaaccacagaatttaatctagaactggaagtgatttgggaggtctcttggcagtaaggttaggtgttcatttactctatgggtagttataattcaacaaccacagaatggccgagaactacatttgtaagtgggcaagatagcacatgcgccttctctaaattcaatacatcgttgtataaagccaagaggtatgaaatgaactatttcatagccaagaaagggtgaaaaaagccacaattataggcaatccaggctctattttaagtactgcacacttgagtgtaaggggatatcagaaaggagaaaaattgctagaaatgcagtattttagccttaataacagaatcatgtctcatctcttgctgcagcgttgggaatagataacaattttatcaacaacacctgtatacatgactcacctattcacctcattcctagccacctttggttgggtgagtataaggaaaaatgaaacaaacttcttgtatgacaggaactcatgattttctatatacattttgcattctggttttacctttttctgtcaacattttggtgtttcagcctttagatgaatttatgggaagagtgtggtggggtcagaggagagaatgtggagctgggagccaggtcactgcacttacttttgctttgctgacaaccatctgggtaaccttaggcaagtgaaacacactgttcttggattcccgtttcctcaactgtaaaacgaaaagtttggactggatgtgagaattattgcctttaggtgccaagcaaatgatcaaaaggtatgatggagtcagtggaagacattaagggaaatgatgaggcttatggccaaattgggcagtttctgctttttctaaaaacatttcaatttcttccttgctccctccctctttgcttccttttttttcttctctctttttccctcttttcctccctcttttcttccaagaaggaagccaagcaaaacacacccagagcctgattcccctttagacaccactctctgaccctttgatcattaatgttccttccatcagcacttgtttggaccagatgaatgattaagggctatgtttttgtcttatggaaatgagagtaaggagttgaaccaggtacacagaaagtgagaggatgaatatgagaagaaaatatataatctcagggatgggccttgtctttacgaattgatgtagttcaagaaaaccaaagataaggttgactttctatgttttgcttgtatatgattagcacatctatccaaatcctgcaaagtggctcacaattgtagaagggctgtgttagtcttactagccaacaatttggtcagtgtattagccagcagtgatatcatctggctgtcttaagaaaacatatgtgtaactcaaataagtattcctgttttcttataaaacttgtatttcttttttgcttttctcaaatattttctggatttttaaatattgtttgccatatgcactatataggaatatacacacataaacatgaggggttttttgctgataaaattcaaattatacatattcatcttttgttttatatattcatgtggcttttctttttcttttttttttttttttaatctcagctcactgcaacttccacctcccaggtttaagcgattctcctgcctcagcctcccgagtagctgggttacaggcacgtgccaacacacctggctaattttgtatttttagtagagacggggtttctccatattggtcaggctggtctcaaactcccaacctcaggtgatctgcctgccttggcctcccaaagtgctgggattacaggcatgagccacggtgcccgactttttttttttcttttgagacagggtcttattcttttgcccaggctggagtgcagtgatgtgatcttggctcactgcaacttctgcctcctgagttcaagcgattctcctgcctcagcctcccgagtagctgtgattacaggtgccaccaccacgcccggctaatttttttatttttagtagaggcagggtttcaccatgttgcccaggctggtctcgaactcctggcctcaagtgatccacctgccttggcctcccaaagtgctgggattacaggcatgagccattgtgcctggcctcatgtggctcttcttagtgcctttaacttttatgatcttttattttactagaacttaaaagtacaatctcaatttttctttcctactactgatgagataaaattggcaaaagacaggatttagcaaccagaaaagaaatgagtgttctacaagtaaatagtcatccctggaataatctaaatcaaaggtatgtttcagtgttaggagattgtaggggtactttttcatgttctttgtcagaaataggtatagagtaagtttttttcaaactattgagatactgagagtaataatattctctcctgggatgtttaaagacttatggtctgatcacattgccagtttgtgctaagattttcaccattttacttgatgataactcttctcagagtccaaaagtagacaaggtagctagaaatgcccttgtgcactggctgaagcaatcctgatgatggcggaacttcatcaaagcccactggatacttaaagggatggccttagggcaaatattgcttttaggccctgaaacaaaataaagctaaatatgaatctgagctcttgcttctgatagatataacacctattcctgacacctggatcagatgtgtcccatcatggcactgtcggtctcaggctgtgtcctccccaccagcactcctgtggcagaatagctcactgtcacgctcattttccatcaagaggcggcaacacttacaatgtaatgtggtcagagtgatagcaagtctcccctcaacactgaaaactcttgttttattgatctcgttttattgacttgaaaactgtcttgttttattgatttttttttattgtcacaattgggggtggagatgagtgctgctggcctctggtaggcagaagccagggatgctattaaactggcacaacacagccccttccaaaagagaattatcaggtccaaactgtcaatagtgctgaggttgagaaatcacgatctagaagtacaggctttgcttgtagcccttgatctgcaagaatcctactttacagtaattacaagtaaggatatacagattgtatttgctggtgattttacctatgttctttgccagcctggctaggtttacttcttttatcagtggaaagtgacaggtgcatcagtcctctccactgatgccaaagaaataccaggtgtatcccttagaatgcatatagccaatctcctggatttgccaacacccacatatctttaatggtcttccagacattgctttcttaagatgtttacattctttatcagattatcttttactcctggcgccaaccactttagcatgttttcagttattagagtcttaggatagtattttctttgagattcaaacaaaaaagtattctacatagtacttgtaatctctttcacaattgtaattgcctttcacaaagccgacattgtctgattttttgattctgctgtttatatcttggtagtgttacctgttggtcccctagtaaacagtgacagcaatcttctgaaccaggctgaggcccagtcaagtgtagatagacatgtatttcttatctcactgtggttttatttttctgcatgtctgccctaatcaaagcttgtgctgggagctgcagtgcatctcatatctcggcctcgggaggaatggttcattgcatattctctcagagacagctgggcgcttcgcagggagtggtccccctccctgtcaccagggcaattctctttcacatctcccaggacagatggagaatgaagaaattaataattcatagtgtgtatttaagtggtgattcttcctagactgagacatacttgcattttgttcaaaaacatcttgatgaagacaggcccagtggtgacctaagagttagaacataggaagtagggaaactcttactaagaaaatggacaatacaggccaggcagggtggctcacgcctgtaatcccagcactttgggaggctgaggcggaaggatcacctgaggtcgagggtttgagaccagcctgaccaacatggagaaaccctgtctctaccaaaaatacaaaattacccaggtgtggtggtgcatgcctgtaatcccagctactcaggaggctgaggcaggagaattgcttgaacctgggaggcggaggttgcagtgagccgagattgcaccattgcactccagcctgggcaaccagagcgaaaactccatctcaaaaaaaaaagaagaaagaaaatggacaagacagactgaaattagctagcagccattagctcaggtaccttttaagtgctcattgtactgattgatgtttggatagtgcattagcagaaatattatctacttgcacttacgttcatgtgatctgtaggactcaggggtcctgtttgtgtctgtagtcatagttaagtttatagtcagttcctggttggtgctggggaaaagaaatcaggatgcattcattgtgaaatacccttactgtcctctcaggagagaagaggaaatgagtgtgttctctctcttggttagaaacagataaagctgtgtcccattagcagttggataggaaacggtaactggaaccttctgtctaatctggtttccttaaatgtaaggagcagataactgcatctggggagtagtgctcttaataaggattatgggggcttcagttgcaatggctccagttgaagagccatgggatttcatctgtcctgaatcatctgagtgttattcttcttcacattaactgtgtttatctgttatagtatataattatgctggtttgttatgtatttgaaaagcacttagcatgttttgaaatgtagcgttgaaatgactttaaaatgtcaactctgtagttttagttttagggcacagttcttgcaaattcctgcttttcctctctgaccctagtaactctgaaatcagtagttgcaaacaaacaaaccctaaagccttgtgtgtcacttttctttgggatagttgttgaattcaatagctcattatttcacgtaatattatgttcatagtgcaatttaacatgtagtctttgaatgttataaattctaaaagattaaacaagaacattagaaaaggaatgaaaagtgctcttaaaatcctgccctaggccgggcatggtggctcactcctgtaatcccagcactttgggaggccaaggtgggtggatcacctgaggttaggagtttgagaccagcctggccaacacggtgaaaccccatctctactaaaaatacaaaaattaggtgggtgtggtggcgcatgcctgtaatcccagctactcgggaggctgaggcaggaaaaatgcttgaacctgggaggcggaggttgcagtgagccaagatcgcaccattgcactccagcctggggacaacagggagacttcgtctccaaaaaaaaaaaaaactcctgcctttcttgtaatctgatgaaagaactctgcctacagaggcttttaactatgcaaattctttccatattttttttctttttcctaatatagtttattagcttttactcagactaggtataaataaataattatcccttgccttagaggtgaagtcatttgaaagctccatggaatacatttcttctttaaaaacgcaacaaaaattttttattgtaaattgacaatttataattgtataaatttatgggttacaaagtgatgtcataaattgtggatacaatgtggaataattaaataaagctagttaacatatccaatacttccaatacatttctgtgatgagaacatcaattttgaaatgtgtaatactccattattaagtatatgcaccacactgtacaatagaactcaaaaaaagtataaaacatattcttcctgtctgagattttgtaccctttgaccatcactgaatttttttttctttttctttttttttttttatgagacagtctcactctgtcacccagcctggaatgcagtggtgtgatctcggctcactgcaacctccgccccccggcttcaagcaactctgttgcctcagcctccccagcagccaggaccacaggcacacaacaccacaacctgccaaccttttttgtatttttagtacagatggggttttgtcacgttgttcaggctggtcttgaactcttgacctcaggtgatccacccaccttagcctcccaaagtcccaggaccacagacatgagccactgtgcctggactaaaatttttatgagacaaaatatcaatttcaaaacagcatcaaaaagtgagtaggccaggcacggtggctcatgcctgcaatcccagcactttgggaggccgaggtgtatttttctgtactaaaaatacaaaagtatttgtctctattataaatacaaaaaaaaaaaaagaaattagctgggcactgtggcacatgcctgcaatcccagccactcaggaggctgaggaaggagaaccatctgaaccctggaggcagagccacagtgagctgagactgcactacttgcactccagcctgggcaacaagagtgcaacttcgtctcaaaaaaaaaaaaaaaaaaatgctgggcgcggtggctcacgcttgtaaccccagcactttgggaggccgaggcaggcggatcacaaagtcaggagatcgagaccatcctcgctaacacggtgaaaccctgtctgtactaaaagtacaaaaattagctgcgcgtggtggcgtgtaactgtagtcccagtttctcgggaggctgaggcaggagaatggcgtgaacctgagaggcggaggttgtagtgagtgaagatcgcaccactacactgcagcctgggcgacagagcgagactccgtcttaaaaaaaaaaaaaagaaatatacatgataggaattccaggaatcttatggattcttcttttaaggtcccggtcactgggcgtggtggcttacgcctgtaatcccaagacttttggaggctgagacgggcggatttcacctgaggtcgggagtttgagaccagcctgaccaacgtggagaaaccccgtctctactaaaaaaaaatacagaattagccgggcgtggtgacaggtacctgtaatcccagctattggggaggctgaggcaggagaatcgcttgaacccgagaggcggagggtgcggtgagccgagattgcgccatcgcactccagcctgggcgacaagagccaaactccctctcaagaaaaaaaaaaaaaaagtcccggtcaactgtgggcacaatgtaacacttacacacacttaggctgagttactctctgtactaagcagtcatgtgcataggttcctgtgtgtgtacatggtaattgttcaaatcttggatccttggcgatccttagagccactcaatacttctgccccaatttctcaatttcagccattacacaatcagttatacaagggatacacttgacatgcagacagcccatcattgactgcactaagtccagtttggcttttatggaaaagttgataaagttggtatcaacgaggatgtggtaaggtgggcccagctgtgtattatattggcaaaataatcaggaaaggtgttgcggaacttctctttcctttaacgcgctgggatccttcttttctttctctttaggttttaatctatccttttctttaagcctctgatctctgagactaagcgtttgcttcatggttgtatagttcctcattttcttttgcttcctcatggtcacaccacactcctgtttcttccgtaatcaccaacggtgcaatgcttttacctggaatacatttttatgttagtcaaactgtctcgttcctttctaatagattcaataaagataagtgttttattcgtggatttaagggcataaatctaaagctccatgaactgaattgcttatcatgtaacactttgattttccttttccatgaccaaatcgcttttctattctattttctaatactaagttattgtaaaactatcacagtttcatatattcccaaaaccaggaatgcgtcttatctgaacttccttaaactcatgatgagtcagaggaggccagttttcattagtaatcagcgccaaattcatttcaaagaaagatctgtgtggacataggattggtatggagaaaaatatggtgataaattaactgtgtctcttgtatagttgagtaatagaatttcattgtcgaaccctgacctgaaatacatgttttcttttatcaaagtagaaaatgagttgctgcaagtaaagaaactgtattagatattgtataacagagactttttttttctattaagtactaacattgcttttgtttctgttccaaactttgaaatcagtgcacttggacaaaatggaaactgcttttcaaggtcctacagaatatatgtttataaatgtatttttatacatggttggtaatgaatcaggtctctttcgtgccattgcagttagagggcctctggtgctggagtcctctggaggactgggctgtcagagtggggcagcggggtgcagcgcggggagggcttttctctttcttcgtgcctctggtgctggagtcctctggaggactgggctgtcagagtggggcagcggggtgcagtgcggggagggcttttctctttcttcatggggtctcagggcctctctcttcctctccacgtatgctcttcacaggtctctccagcagggtagtcagatatcttacatagcggcttagggctcccaaaagcaaacattccaagaggaagcagaagctgccagtccttttaaagatgaggcttgggtgtgacatggtataacttttattgcattctattggttaatgcagattacaggcccagtcagtttcagattagaagagaacaagggaatgaggctgggttccttggaggctatttttttttttttttttttctgaaacagtctcgctctcttgccaggctggagtgcagtggtgcgatctcggctcgctgcaaccccttggaggctatttttagagatgaactatcacagtaatataccttaaaatacttcattttagacagtttttgtgtgttctaggggtggtcagttgcactaaccaagaatctatgaggtgtggttggccagcagtatatagaaagagctgtaccgccggggctgccactataagcacttcagctatgcaaattttgatcaaaactaggccagacatgtggatgtctcttggtgggggagggatttcctgtccccagggacaatgaggcttccctaggttggaactgggtgtgacgcagtcccttttgctggctcttcccacctccccactgctcctttcgtccccctctgtctccaagttggtaaaggagtcaggcatggtgggaaggagagcacttcccttagcaagttattgtttaatgggagctggtgggaagagttctgtcatttaatccttgccggtggtgctatatgtagtgaaatcaactgctacagtggtaggggccttagagatcatcaagtcctacctctaaaccatgaagttaatcttctctcaccatctttggcacatccctcagcaagctagaaacagaactctgcgttttttccataaagtacgagaaataatgatttcacctttaaaaactgccttcctgagtaagtgtccgtttggtcaaccagactccatgggtcctaactttcgtcaggttgttcttgcagaacatgccagcagaagcattcaccaactgacatgtgccctgaaagaaggcgatgtcactattggagaagatgcaccaaatctttcttttagcaccagtgtgggaaatgaggacgccaggacagcctggcccgaattacaacagagccatgctggtgagtgtgaatgtcaatcctagtctgaatgatgcatagtgaattttttaaactccgtagaataataactccattcattcttcattctgctgctatgatgttattcctcaaacacaaatcagataatttaattccctcgcttaatcttgttttcctttgacttcccaatgcttataggctaaagtccaaaattcttagttataaaataacagtgttttcctaagatagctctaacctgcctcttcggctcatctttgtgtacttctcatgctaatcatccatctcacaactcatattctagttataataacctcctctctatgcttttatgctttgacatgtgcagtgacttctaactggaatttttcttatccttttctgcttggtgaactccttcctgtttatccttgcagtgttatctcctctgtgaaaacaagcacaattagcttcttcctcttcttgtagcactgtgcatagctttaggtctacatacaaacttattttatatctattagtgtctctctcttccttgctagattcttagctcttaaggggtagaaattctttttttttttttatgttggtcttgtatccccagttgatagcagaattcttgatgcataatatatcagcaatttttattagttggaaggatggatgggtggtaagaaaccatggatctcaaataaggttaataaaccctctgcttttgctctatagttaatcagctcaaagatttgttgcgccaacaagcagataaggaaagtgaagtatctccgtcaagaagaagaaaaatgtcccccttggtaagtatcaacttttccaagttgacaaagcattcctgtgttttactgtattgtgttattttgtagtacatgttgcagaaaaaatttaagcatggcatactaatagtgaaaaacattaaaagtaattctcttccctctgattattttggctgaaaaaatagatttccatggcagagggaatcttgattttttaaatttattattcacttggaaaatgggagcaagggaatagtttggagaatttattttgcaactgttagcaaaatatgtaatataaatatataatatataataaattaatataataaattatatgtcagaatatatgtaaaagataaagtcattattttagtaatttcttttttagagggtcatatctattattgatcatttttagaagttacttaattataattgtagccctactttgtaatattttttaaattttgagtgtcaaaataatacattttatttttaattaattaattaatttttttgagacagagtctcattctgttgctcaggctagagtgcagtggcatgatctcgcctcactacaacctctgcctccctggttcaagcgattctcctgcctcagcctccctagtatttgggtttacagatgtgcactaccacaccaggctaattttttgtatttttagtagagatggggtttcaccatattggctaggctggtctcgaactctgaacctcaggaaatccatcagcctcggcctcccaaagcaccgggattataggtgtgagccaccgcgcctggcctcaaaataatacgttttaatatgtaatgttctatatgttaaaatatatggttataaaatagtatgatatataagaagtggtgctgtatttcttctgaagttgtttgttattgctttgacagagtgtattatttctgattaaagcattttatatgctaaaggctgagatagatgtgagtgaaagcactctggaccagatttaagtggacaaaataatagtcaagggcttagttctatctagggtctatcacatactctctaagatattgtgcctgtctcacagagtttttggaataatgagataagattacatacttaaaattctttagaaacctatgaagtgttacataaacataacatgcatagcagcaagtaaccacctcacattttcaatgtgttttctagttcaatacaatgcctgtatgctgaaaagtgtggagacatgtcactttcttttcttcaccactgaaatatcagagtatcactcccatacgaacactccattccaggctgacacatacttttaagcttaattcctactttagagaaatgtacttcatatgcatattctaaatttatagatacagattttataattttagtaaaacatctcatcatttaatgaatttattactattgacatctggtttctagcttgctcttaagcacagactggtggaatgcttttaaatctactagatgaagttgctttatctgttgaatgctcagacatgcttatttgccttttaaagtctgagcagtgatattatggagcttactgaatccagacaggcaggaagaccttcactaagagaatcagtttagtacatacagagtgcactttaaaatacacaagtctatttatatggagctatgtaaaagaatggaacttagactctatatgtatacagcctacatgtaataattataaaccataatagtaataattagctttttaagattatacctttagaatgcactttcatagccagtataacatattagaaatacatgcatatattgagagtaaaactgaggcactgttgagatggaaaaaaagttattacttattgtcttaaaatgtagatatctaaactaaagcccttcaaagtagacacaaatgatttcatgtgaacatttttcatacaatattggcttgagctttttatttttcacattgacttcctcctgtatactcatagtagtaatttatatttgcctatcttctgaacctattgctattaatggaggatgattataattgtttgatttctactcaggacagataattcatttaattagagttactttggtttttaaatttcttaaatataccaaaaaaccaaagctctattttattttattctgccatgatagctggtacttgattatcatttaaaatgtctgctgtgctgagaaagagagtggctgagaaacagacactgtgcctcatttcaagctttcctctggctttgtttaactggttgacccttgttttaccttttcctgatttcctcatcctttaaaaaaaaaattatgtgatgggtatatgattttacaaactattttaggataaggtaagctatacattaacagtcagttccaggaatgctacagagctaaaatagcattagcgtttttttgaaatctcttcgttggacccctcaatgcagtgtgtctctactttagggttctactcttggaggttctatgctccagaacaccatacacttgaattgccttcaatactagagccaaaaatcaaaaactacattttgctaatgtatcttttttgagatggaatttcatcgcattgacactggcttggcatcaaacgcttcctaaagaatctctccttcacggagctgctgcagttttagctagcaaatcctcttccatggcagtttcttggagagagttgtcccttgtatctcagcattactgaatggaatgttgtttttccaatttgttaaaatagtttattccaagccagttatactactgctaccccagcatttttccattcactatatgtgctttttataaccactttcaccatccatctttaaaaaaaatgatattcacatccatgaatcttgtgtatttgtggaatttataggatagagaagcaagtatttgtattagtccattctcgtgttgctaaaaataaatacctgaggctgggtaatttatttaaaaaagaggtttaatcagctcatggttctgcaggctgtataggaagtgtgatactggcatctcactctggtgagggcctcaggaaactttcagtcatggtggaaggtgaaaggggagcaggcatttcatgtggtgagagccagagcaagaagtgggagaggtgtcacattcttttaaacaaccaaatctcaccaaaactcagagcaagaactcattatcatgaggatagcaccaagattcattcatcatgaccgaaacacctcccaccaggccccacctccaatgctgggggccacatttcaacttgaggtttgtgggggacaagcatccaaactatatcaagactataagctacattgtgatcgattctatgtttatatcacatcagtgcaaaattgagtatggagaaggtaacaactgattctttgctaaatccaaacatgcttaatttggctttttaaaatttatgtatttatgtatttatttatttattttttgtcatagaggtcattagaacatgaggaaaccaatatgcctactatgcacgaccttgttcatactattaatgaccagtctcaatatattcatcatttagaggcagaagttaagttctgcaaggtaagtttctcattaagaatttaaaactaaataaatgaaagcttatattaactatagattgtattaaaatttgctgctataaatcttcatgtttgtagcaatacattgacaattgctattcttacgtgattgagagactgatgtgtcacaagagcttgtcagacttgggaatgatgctcttgaccataccatttctgattgcttgatttcccagtagttcattactatgtctaatgatttcataatatgctttcatatttcagaagttttccttctcaccccgcttgctgtagcccagcaaatggcaaatgctttggaatacaaataccaatcattctcccatacttgtcaacctactggagcagtggtacagcaatcagggattctaaactggtagaccaattcttctccgctgtcagtattaaggctcttactttgactttgaatgagaatggttcatagggtactgacagtaatgatcaagaaaccaaacacatcatatatagcttatgacactagaaggttatatgctcaactgcgtgcagtttgctaatgtcattaatgctaatagagccttttcatcttcccgaagtatgtcgtgttttacttttttttttctgtttctttctctctttctttctttccctccctctttctttctttctagtatcagtgtattcgattgtatgatatttttataggaatcactgatatctcttgtatcatgtttttatatatagtatatgatattatgtattatattgttgacattttaagatgcaaggccagtatgtaacttaaggaggctttagatgtttcactgtcctgattttaccggggagtttctgatcttaacatgtaatttcctgtttgttcttggaggacacagttattaatatacacgtggtcctggattaccagtaaagctgaaataatatcctaggaactatttcattaacaatactctattaatccctaagatgttgtggataaaacttgaaagatataaagcagaataaatttactatctagttgagaagacagaactattccctattaacaccataaggagcacattagagaacatagtataggcctttactttttggtataagctataattataataagagaagaaggttaggaaaagctactgtctttgggaatgtttctatgggagagagagatcttgaaccaatgttttttttttttttttttttttttttttgatggagtctcgcattgtcgccagactggagtgcggtgtcacagtctccgctcactgcaacctccgactccctggttcaagctattctcctgcctcagcctccccagtagctgggattacaggcctgcgccaccacgcccagctaatttttgtattttttgtagagacggggtttcaccatgttggccagcatggtctcgatctcttgacctcgtgatccgtccgccttggtctcccaaagtgctggaattaccggtatgagccacgatgcccggcctaaaccagtcttaaaggaataggatcatttagatcagcagaagggagatgagtttcataaagagaatggcaacagtgaaacacagtattcaggatgaatatggtttgtgggggccataagccatctactttatcttcctgcagtggagaatgtctcatagaaataatgaaagtaatcctgaactggtaaaatggaagattacggaagccttgactgtcagacagagtgtaaatttgatacattttagtaagagaagaatagaattaaaataatgtttaagtggtttagaaagattttgtttatttagttaatggactttattttttagatcagttttaggtttatagaaaggttgaatggcaaacacatagagtcctgtatcctcctttcagtgacatccctcacctaatagtttcccttgttattaacatcttgcatcagtgtggcacatttgttacaactgatgaaccactattgttaaattattattatctaagtctctcagtttgcattagctttgtgttatacattctacgaatttgacaagtgtataatgacatatatccaccattacagtatcatatagaatagtttcactgtctgaaacatcctcttgcgcttcacttattcatccctcttcccctccgccccttccctcccatcccctggcaaccattgatctttttactctctccatagttttgacttgcagaatgtcatatacttggaattattctgtatatagccttttctgactggcctattatacttagtaatatgaattcaagtttcctccttgtcttttcataacttgatagctcatttctttttattattaagtagtattcaattagatgaatataccatagcttttttatctgtgcacctatgggagggcatctttgttgcttccaagttttggcaattgcgaataaagctactgtaagcatttgtgtgtcagtttttgtgtggacatctgtttttacctctttaaagtaaataccaagaagctcaatttctgcatcatatggtaagactaattttaactttgcaagaaattgcctaacttttctaaagtggttgtaccgttatgcattatgcagtaaatgagagttcctaatactccatatcctcattagcatttggtgttgtcagtgttttagattttagctgttctaatagatgtgtagtggaacctcattgctgttttaatttcaattccctgatcacaaatgatgctgagcatcttttcctatgcctatattccacctatgtaacatctttgagtgaggtgtctgttcaggtcgttcacccatttttaaaatcaggttattcgttttcttagtgttgagtttcaacaattctttctgtattttggatgccagtcctttatcagatatgtctttttcaagtattttctcccagtctttgacttggcatttacttctcttaacagtatctttcaatgagcagaaatttttaattttaatgaagtttaacttaccaatttttttctttcatagattgtacttttaactttgtgtttaaaaatttattaccaaatccaggttcactatattttctcctttcttcttctagtattttataattgtttattttacatttagatcatgtttgaaggatagttgtccatatttttgggtctatttctgggctttcctgttccattgattaacttgtcaattctttggccactatcactctatcttgattactgtagctttacattaagtcttgaagttgggtaatatcagtactctaattttgttctttttcaatattgtgatgagtattctgggacttttgcatctccctgtaaactttagaatcagtttgtcgatatccacaaaataggatttggattggaattgtgttggatctattgatcaagttgggaataactggcattttgatactattgagtatccctatccatgaacatggaatatctctatttacttagatcttctttgatttctttaatcagtgttgtggttttcctcaaatagatcttctacaaattttgtgagatttatacctatttcattttatttttgaggtggagtctcgctctgtcacccaggctggagtgcaatgttgcagtcttagctcactacatcctccgcctcccgggttcaaacaattcttctgcctcagcctcccgaatagctgggactacaggtgtgtgccaccacacctggctaatttttgtatttttaatagagatggggtttcactatgttggccaggctgctctcgaactcctgaactcgtgatccacccgcctcggtctcccaaagtgctgggattacaggcatgagccactgtgcccagccacctattttattttttagtgtaatggtattatgtatttaatttcaaattccaattatttattgctaatatagaagaaaacaattgactttgtatattgaccttgtattctgcaaccttggtataagtcacttattagttccagcattttttgttgattctttgggattttcctcattgacaagcatattgtctgcaaacgaaagacagtgttattttctcctttccaatatatttagattttgtgttttttaaatttttcatttattttaattaattttcttgaggaagggtcttgctggagtgcacaggctggagtgcagtggcataatcatggctcactgtagccttgacatcctgggcgcaagtgatcctcctaccacagcctccctagtagctgggaccacaggtgcacaccaccatgcttggctattttattattattattattatttgtagaattgaggtctcatcatgttgcccaggctggtcttgaactcctgggctcaaacagtcctcctgcctgggcttcccaaggtgttgagattacaggctttagcaaatgtgcccagccagattttatttttttaattgtcttattgcattagctaagactttttggaatgatgttgaatggttgtgagaggggccatctttgccttgttcctgatcttagtgggaaactactttcctaccataaagtatattagctataggttatttgtagatgttctttatcaagttgagaatgtttcctctattcctagttactgagagtacagatgcctctcgacttaaaatgggattgcgtcctgataaactcgttgtaagttgaaaatgcattgaatatactatagattattggttgtttacctctgtgattgcatggctaactgggagctacagctcactgccactgctgctgcccagcatcatgagagaatattatactacatattgctagcttgagaaaataacaaaatttgaaacttgaattatggtttctactgaatgcatattgcttttgcagcataataacgtcaaaaaaatcataagtcaaaccatcacaagtcagggaccatctgtgtttatcatagatggctgccgcattttgtcaaaagcttttcctgcctctactgttaaaattatgatttttcttctcaacattgttgatatgatggattacattaactgatcctcaaatgtcgaaccaatgttgtgtaattagaataaatcttactttatcctggtgtataattcttttttacattgttggatttgatttgctagtattttattgaggattttttcatctatgttcattagacatattgatctgtaattttccactcttgtaatgttttcacttggttcgggtattaggttaatgctggcctcataaaatgagttaggaaatacttcctcttgaattttatgaaatatattatagataattggtataatttctttcttaaatatttgatagaattcactagtgaacttacctgggcctggtgctttctgttttgaaaggttgctaattattgatttaattttcttgataaatataggtttattcagattatctattcctccctctgtgagttttcatggattgtgtcttacaaagaattggtgcatttcatctaggtgactaaattcatgatcatggagttgttcatagtatttctttgttatcctgttttttaaacatttctttattatccttttaatgttcatgggatcagtagtgatagccccattttcacttctgatcttagtatatgatagaatctaattgatattttctctttttttcttaacctgtatatagtcttatcaattttattcatcttttcaaagacccaacttttggttttgttgtttttctctgttgattttctatttttaatttcattgatttttactctaatttttattatatgttcttttctgcttactctggaattaatttgctattggttttgcaacttctaaagtagaagcttagattatttatttgaaatctttcttcttttctaatttttttacactccttttgctgcatccttttaataagtatatagctttttatcagttgtattttaatttttacttagttgaaaatatttctaaatggctcttgatacttctttgattcatgtgtgtcatttagaagagtgttgtgtcatcatcaagtatttggggagtttcccagctatcgttctgttattgatttctggtttaattccattgttgtctgacagcatactttcctattcttttaaatttgttaaggtttgtacattgtagtctgtcttggtgaatgttctgtgtgagcctgaagaaaacgtgtgtactgctgttcttggatgaagtagtctataaatgtcagttagatccagttgattgatgctgttgttcatttcaattgtgccctttgtgatttttataatttttgacaggggatgttgaaatttccaactgtaatagtggattcatgtgttttcctttgcctcatacattttgatacacttttattaggcacatatacattaagacttgtaacgtcttcttggtgaatggacctctttatcatcatgtaatgtacctctttatctctgatcattttcattggtctgaagtctgctttgtctaaaattcatattgctactccaactttctattgattagtgttaacatgatacatctttcttcatttattttaaatctatctgtgtcttcgtatttataattggcttttttttttgttttgagatttctttttttttttttttggttagagatggggtctcactatattgctcaggctggtcttgaactcctgggctcaagggatcctcccatctcagcctcccaagtaactgggattacagatatgagccaccttgcccagttattataggcttcttgtagacaacatatagtttattgttcttttttttaaccattctgacagtctctatcttttagttggtatattcagaccattatatttaaagagattattgttatgattggatcaatgtataacacatttgttactattatcttcattgtctttattttttgtttctttaaaaaaaattcactctttttctgccttctctggcttttttttttttttttttagagatagagtcttgccctgttacctaggcagtgacgtaatcaaagctcactacagcctagaactcctgggctcaagcagtcctcctaccgcctccctgctgagtagctaggactacagacatgcaccactatgcctggctaatttttatgtttttttacagagatggggtctcactatgttgcccaggctggtggcgaactcctggccccaagtgatcctcccacctcagccttccaaagtgctgggcttacgaggtgtgagccactgcacctgtcccttttgtggctttgattgagcattttatatgattgcattttattttttatttttggagacagagtctctctcagtcgcccaggctgtagtgcagtgactccatcttggcccactgcaacctctgcctcctgggttcaatcaattctcatgcctcagccttcctagtagctaggactacaggtgagccaccacaaccagctaatttttgtatgattgcatttttttccaattcacatatcaattgatcaattgtacttctttttttttttctttgctggtagccgttgattgatgctgttgttatttgcagtaaatatttataactaacttaagtttactttcaagtaaacctatgccacttcttgaatagtataaattgcttataacagaattcccaagccctctctcatcctttataacatttctgccattaacttcagttattcataaactaaaattactacaaacactattgcaattatgatgttgaacacaaagtgtcatctgtcaaattaataagaaaatattttatcttatatccacttattccttctttaatactctttttttctttatgtagatggcagtttctgactttatcaccttttctcctttctgaagaacttttttaaacatttcttgcaaggcatatatgctagcaataaattccatcaattcttgtttgtctaagaaaatatttttctttctcttttgaaggttaatcttgctgaatccagaattctaggttggtgggttttttcttttaacactttaaaaattagattcattttattctcttcctgtttgcacggcttctgcaaagtactcccaggtaattcttatccttgcttctttgtaggtaaggtttttgtttttttgtttgtttgatttttgttttttaattattattatttatttgagactgagtctcgctctatagcacaggctggagtgcagtggcgaggtcttggctcactgcaacctctgcctcctgggttcaagcaattctcatgcctcagcctcccgagtagctgggattacaggtgcctgccaccacacctggctaatttttgtatttttagtagagacagggtttcaccatgttagccaggctggttttgaactcctgaccctcacatgatccgcctgcctcggccttccaaagtgctgggattacaggcatgagccaccgcacccggcctgatttttgggttttctttgtttgtttgtttactttggcttattttaagatttttctctttgtctttgattttctgcagtatcaatatgatattcctcagtgtatttttggggggtatttatcctgcttggtgttcggtgagcttcctagatctgtggtttggtgcctgtcattaattcaggaaatttttcagtcattattgactgaaatgtttcttcttttcctttctttccttttttgtgtccctgtttatttatatatatatatatacatgtatatatatatatttattacacaatttgtaattgtactgcagttcttgtataatttttctgtcttcagtttttttccttattgcacttcttttttggaaattcttattgacaattcttaaagtttactaatgcattcctcagctatatccagtctactgatgagcctttcaaaggcactcttcatgtctgttaatagttttttattttgagcattttcttttcatagagttttcatctctctgcttatattaccccgctgttcttgcatatagtctattttttctattagagaccttaacatagtaatcataattattttatttatttatttattttgagacggagtctcactctgttgcccaggctcaagtgcagtggcgtgatcttggctcactgcaacctctgcctcctgggttcaagtgattctcctgcctcagcctcccgagtggctgggataacaggcatgcaccaccacccccggctagttttttttgcatttttagtagagatggggtttcactatgttggtcaggctggtctcgaactcctgacctcaggtgatcctcccaccttggcctcccaaagtgctgggattacaggtgtgagccaccgtgcctggccttaatcataattattttaaattcctggtctgataattttaacatctttgccttatctcagactgtttctgatgcttgttaaatcttttcaaactgtgtttcagtcttttagcatgtcttgtaattgtttgatgaatgctggacatgacatatttggtaaaaggaactgaggtaagtaggcctttagcatgagcttttatgtttatctggctggaagctaggctgtgtttgctgtcaccgtacatgtcagaggctaaaatttccttcagtgtcctggtcttgtctcttctgttgtctatggattaccctagtgagttcttcctaaatatagtctgagatatgcagttctttctgttgaatttctctgtcagtatacgggagccatagtgatgtggtcgttagatgtgggagtagagggaagcgttcaatagtcctatgactagatctaagtcttttagtaaagcctttgccttgggctgtgacgttcacaagtgcttctcagtctcccctgccctttaagttagacgagatagctagaggaagccggaggccccctctcccacacggaatgcaagagggggctggagctggatttctctttttttaggccggttaggtggcagcagccctccagtcagttaggctctggtaaagtcgtttcccttgaggcaggcctgttacaaggaatgcaacatgccaagcatatttcaaactggctgcttttcttcttcctttaggttgcataaggggatttttttctagtttttactgtgaaaacctggtagtgtcctggagataaaattggggaagtggggcagtccttctatgactgggtcttcctggaatttttttttttttgagacggagtctcgctctgtcacccaggctggagtgcagtggcgtgatcttggctcactgaaaccttggcctcccaggttcaagccattctcctacctcagcctcctgagtagctgggactacaggcgtgtgccatcacacctggctaatttttgtatttttagtagagatggggtttcaccgtattggccaggctggtcttgaacccctgacctcatgatctgcccacctcagcctcaaaatgctgggattacaggcgtgagccaccgcgcccggtctggaatttttaactctcaaacttgctgacactgagcttccagcaagtcatcaattatgatttagattttctacctcctacagaggtttctgatttcctcctgtaaattctgtgtctcagcgtccacccatctcttcagttttggggcagcagttttccctatgacttcatttctctgatggatctaagaagagttgttgattttcagtttgttcaacatttttcctgttgggaagatgggagtgaggtgttccaagctcattacattccagactgaaaattcaaagtccacaatattttttaaattacagctttttattatagctttgggtttttaaaaaataataattgagaggaattttcacatgttgtacaatagcttttgattgcactagtagtgaatattaggttaagtattatatgattgatatgttgatattattgaaacgtttttccagagactgaggtgccactcaatagctattctaatgattgttgacctgtaatttcttatgttacatcctgtaattttaattgttattgatttgtaattctttatattacaccctgtgaggccaaggaaatactctttcacaattctccatgaaatgttttactacaattctctcttatttggctaccatttcatagataatcatcactcccgtctatgcctttctatctcagagcctccctctatttaatcttccatcagtttttaacaagttgatggtatttgatcatgagtaataatatatcttatttttcagaatctactccattctttaaaatctcttggataacccttttaattaaggcttttctttgagcctcgattccttggagaaaaggaaattgtcagaaacgacacacttctgtgatatgccaccagcaggcccattactatataccccagccttctctttgttatctagctaatgttaggctgccttgtttgtctaaacatataattatatttcaggaaaaggagaacataagtcttccgtactttatatcatgctgtgccctctaataatcaacaaataaaaacactgcttaataatgcttaatgtgtttggttttgtttattataggaggaactctctggaatgaaaaataaaatacaagtagttgtgcttgaaaacgaagggctccagcaacagctaaaatctcaaagacaagaggagacactgagggaacaaacacttctggatgcatccgtgagcattattttaaatcataaattttattttagtgtgaatattcccttctgccctctctcctcgccttcttcgctgcttagattttctccctgaagtgtggccaaagtactatgttggtatttgtttgagacctcaaatatcaaacttcactgtggtggaatgaatcctcagatgaaacgatcttgtgatattttgctacagtttcctctctgagcataccgtttctgccttaccatatggaaagagccggtctgaaagcaggaagtgtgttatacaggaaggactttgctaagtctagaaaccgttcagaactttaacttagatttctgttggatttctctaaattttccttgaggtctgaaatctaataagtctaattagctgcatgatgtagcagaaaaaatgttggccttaggatccaagaatcaaaatgttagtcttcccatttccctaagaaggctggtgtttagcaagtaattttagaaggttttacatagcttaatcacgtatgtcctttatttctttattggtaatttgagaagattaacctataccaggagttttcagtgcaaattcctggactccatcccctgtgagtctgattcacttggtctggttggcttctaggaatctaaactttcatcaagttgcctaagtgattctaatgtcagtggcccagagtttgaagaacgttgggtcagattatctctataattctgtgacagagaattattgtggtgacatttaaatagtgcttaaatcttatgacttatcagagtacttttgtcttaaactttttgtaactgttttgctataagatatagtcacagcttgttctgctttttgggacaaattcaactttccatgtggaagttttcatacttgcctattccagcttcactttgcagtttactttggtggttttgactttgtcgtcattagtaaatcagctgttaagaaaacatgaaagtcttgatgtttcattgggatatcctctaattttcgtttttgaagttttttttttttttaacttgaattgatagttggtttataatcctggagttgtatatgttagggtttgctattgagaagtataggagtgtattaactctgataaatgaagtgggctaattagtatttcagtttaattttctgcaattgcatttaagtttgtgatcagttcttttctcctcactgtataactttttcctgaagatttgtataattattagtggtaaaaactccatcttagttgcttatgattttaatgtcaatttgaggaagatatcaccatatagaaaatacttagaagtagcttattttaaaaatattcatttgcttttcttccaaacacgtggtcacttagcaagcagtgattcaattattcatagtcctcagtatttatgtaatgccaaagaagtggaagaaggggaagtgaagtgagaaaggaaattaggcagacaagtgaatcagagggcaagagaaatgagtaatgcaaaaggggaaggaaatgatggtcagagcacacatgccttgcagcatgagcaaagaaaatgtgctaaacaaaactacagtcagaatcatagaaaggataaggttttagagaggttttgttgttttttaaacattcatgtgagctaaatataatgcaggtattgaaatgattactgcagatatgccagatgaccttgatatctattttaatgttaatcttctgttatttgttgttgttgaattgttacccccacgttttacctgtgtaagtgaattgaaatatttcaaggccagatacagtgtcttacgcatgtaatttcagcagtttggaaggatgatcacacgaacggatggatcacttgagcccaagagttccagacaagcctgggcaacatagtgagaccccatctctctaaaaataaaaaaaaaattagccgagcatgctgatgtacacctgtggtcccaactactttggagactgaggtcagaggatcccaggaggtcaaggctgcagtaagccctgatcacgccactgcactccagcctgggcaacagagtgagaccttgcctcaataaaaacaagacaaacaaaaaaccagacatttcaataatacatgcatggtgctgtgttacaagttgtaacatgaataaaaatgtttaggatatcttaaatataaaaaatcaagaaatatcttcttttggggggaaggggtttttgtaatgagtcaattaaaatgttggtgctaaatcttcccttgctatattgaagtttgctgatttcaatatagattttcagtgtttcataatgccttttaagaaagataattgaggtggccaggcgcagtggctcacgcctgtaatcccaacactttgggagaccaaggtgggtggatcacgaggtcaggaaatagagaccatcctggctaacatggtgaaacccaactctactaaaaatacaaaaaattagccgggcgtggtggtgggcacctgtagtcccagctacttgggaggctgaggcaggagaatggtgtgaacccaggaggcagagcttgcagtgagctgagactgcgccactgcactctggcctgggcgacagagcaagactccatctcaaaaaaaaaaaaaaaagataattgaaacatttatatggtgtattaggttctctcaaaggacagaactaatatgatataatatatatatatgaagggggtttattaagtagtattaacttattaactgacacaatcacaaggtcccacaacaggccatctgcaagctgaggagcaaggaagccagtctgagtcccaaagctgaagaacccgctgtctgaggtacaagaacaggaagcatctagcacaggagaaagatgtaggctgggaggctaagccagtctaaccttttcatgtttttctgcctgctttatattcgctggcagctgattagatggtgcccacccagattaagggtgggtctgccttccccagcccactgactcaaatgttaatctcttttagcaacatcctcacagacacacccaggatcaatcctttgcatccttcaatccagttaagttgacactcagtattaaccatctcatatagtaataactaacatttattgatgactacatggttataatgtgcgaggcactgtgtcaaactatttacgttatattacttcagatttgcagtacccacacaaggcaggtgttattatctctgttttcagaggagtaaattaaggtacacagctgttaagtaacctaagtaattggcctaatgtcacagagctagataatggcaaagcaaggattcaaacccaggactatctaattctctaaatacaccccgtagaaccttaaattataccgcctttctgcataagttaggaagagcttgtcgacattgaaccaaaccatctttgtttgcagaggatagaagttttccctggcagaaaagagaagaatctcctttttattgtctcctgcttgtagccctggactttgatggtagcctgtaagactttcaacttttggtctagtttatgacctagaagttaaagaagcaagccattcaaagtatatttcattcctgtcctgatttttcatcactttgccttctcataaaatatttcctcatggaaagcttttctctagagttcacaaaatcaaaataatacgaaaacatgttatttattcaacattttgtcatgtgtccttctttaaagatccaggagttttttcttaaggagaaaatttctcggccaatatttttcacgtttgttttcatcccctgtcttaccaccgctcccgccccccgatcccctgccacccaattaagaaatcaaaggttttgaatgatcttcaaggatttaacatacttaggtttttaaaaacatcttggttaagtagcattcaagttttttaaaactatctgtgaaagaacaaaatgtccgttagactagcaattctttccaaagaatgataatattttatatcataagttagtgatctgtggtctacatgctccctccaatttctccatagaaaattagtaccaccctccttcattgatctcaaaaacaactttaaatgcaatcatatcttaggggatttgactctaccgagagaatcaagtgcagactcattccatggtgtggtatactctcaagtcccttacttgattctttagcttcatcttctgacattcatcaccttatgttttgacgtctagtaatgctgaattttctgagacccccctgcaggcaccatgctattccatacctctgtgatgtttatcatgaggttctctcttcttcgaatgccctttccatctagcttacccttacttatccttcaagataccacaccagtgtcaatttttttctggaaaaccttccttggatttctgggtgcccttagtatccctcctgtgttttggcagaggcccctgtgcacacctttggcctagcactcacattattaaattgaaattacctgcctaggtgtgtgtctcccttattagactgtaaactccttggagctaagattgatcttgctcatttttgtcctccaagctcttagcacagtgtctgaacaccataggtgttacacaaatgtttgcactaaactgaacttccagaagaatataaaatagactgtcagagtactactttaggtgaatgtagtttaccacgttcgagcatgatgcgacactgcagtatgggtcagtgtctggggacctgtcctgtcttgtgactactaccatatcctttggcccttagcaagtgctcaataattatttgttgaattaaattaatatacgtattttaatccttcttgtacacataaattccccagatcattgggctgcttactacattgaatgttgagagggtgacagaggttgcaactaacaatgggtacactaaattcaactcaggcatgtttggtttgtttgataaattttgagccagtgtttaatagtgtttcacatgaaggaccagatatctggtaatatgaattttcactgccacatggcagtgattgactggaattgagtagtggctgcttcctttggatggtacacatttctgtggtttgtcacagagcctactcttcttcctttttgaatccctggcatgcaggctgcatgtcaactctgtttatcaccatacatgcactgtttctttttactgaagataaatatttttctggaaaggcagaagatcgtaataataaaggactttaaaggaaaaaactgttcctttttctcataatgcttctgacaccaaatgtttgggtttgttttctcctacacctggccattctctgtttctctgtagataccaactaggtgtccagtgattcaattcaattctgacactcactacacagtatcagacccacaggttaagggctcagtaccacatgactgcctgctactttagataccaactgcaaatagtaggtctcttggttatccacaattctgtctgatttgtctgtaaattggggattcctacaatcccttcctaatgtgtgataatttgctataatggctcacaaaattcagggaaacactttgcttgctattactggtttattattatataaaggatataaatgaacagccaactgaaaaggcacgtagggcagggtccaggctggtcccaagtagaagagcttctgtctgtggagtttgggtacaccaccctcttggcatgtggatgcattcgccaacccagaaattctctgaacttcatcatataggatttttatggaggttttattacataggcatgattggttaaatcaatggctgttggcgattaagtcaatctccagtcctttccccccttgaggtgggggagtggggctgtaagttctagtcttctaatcatggactgcagccaccagtcatcttattagcatacgaaaggatactcttatcaccatggagatcctaagggtcttagaagcacttgtgtcagaaacccgggactaagaccaaatattttaacgaaagatgctcctatcacccatgtcactcaggaaattacagggttttaggaattctgtgtcaggaaccagggacagagaccacatatatatttggattcagattgacaggtttcagattctagtgctgccacttattagccacttcctacctctgtgaccctcagctactctatgtgactcagtttcctcctgtataaaatggaggcaacaatgaaacctatctatcccatagaactgtaatgattaaatgagttaatatatatgacatacataaaacagggtctggaacatagaaagcagcattttgataaaaattattattagccatgcatttatgaaacatggaacatgaaagacaaactaagagagaggtgtgtgcttcaagagtatatgtcttcagaggagtaaagaataattccatttgttgaatgcgctgaaatctagccctctttgcccatatttagattactgcctgtacctgaaggaattttactttgcaacacttgtagaatatgaccctaatagcctgaaaatgtgaagtgattcttgacctgtagtgtagaagcatatgctttttcttttcatcataggtaagaataggtattttatttgtaaaatatgcatgtttatttaaagttgaattcagttgcagttactggcacattttattttagggaaacatgcacaattcttggattacaacaggtgaagattctggggtgggcgaaacctccaaaagaccattttcccatgacaatgcagattttggcaaagctgcatctgctggtgagcagctagaactggtgagtatttgggtgcttttctcttatacatcttttttttctttttctcttttgtacttttttaaaattctggtaaaatatatataacaaaatttaccattataaccatttttaagcgtacagtttatctgcattaagtacattcatgtcactcaatcataaacattatccattttcagaactttttgatcatctcaaacaaaaagtctggacgtattaaacaatatctccattcccctccctgccaacccctgatgacctctcttcaactttcggtctgtataaatttgcctatttcagatacttgacataagtggaattaaacaatacttgtccttttgtgtctggcttatttcccttagcataatattttcaaggttcattttgttgtagcatgtgtcaaaatttcaagactgaataatgttccattgtatgtatgttaccaaactttatccattcatctattgactgatattggggttgtttctatcttttgactgttatgaataattatgctgtgaacattggcatatgagaatctgtttgaatccctgtttcaattattttaagtatatacccagaaatagacttattggatcatatggtaattcttcattcttttttctttctgctcctcagacttgatcattttaattgtcgtttcttaaagttcatcaattcgtttttctacctgctcaaatctgctcttgaatacctttaataaattttttatttcagttattatactttttagctccagaatttctgtttggttcctttttataatgtgttttcctgattttctttagttctttgtccatgtttgtctcttggctctttgagtgtgtttaacacagtcattttaaagtctttccccagtaagtctgatgtctgtggtttctcgagcgtagtttctgtcagcttatcctgttcttttgagtgagcatgttttcctgtttccttgtattccttgttattgtgttgttgaaaattgagcatttccctattgtaatgtgataactctggaaatctttaactccttcttttctagaatttgctgtcttattttacttttgaaggctgtaatactccttttgttttgagacatttccatactatttttgtgaagactattccatatcgtgtgattattgaagtctttgttctattagctcatgttcagctaatgtttgacagagatttccttgaattccaggagctgaaaacaaacaccctccactccccccaaaaggtggggggggggagagagagagagagagaaagagcgagagagagagagagagagaacaacccacctctcccagtcttttcagattgggtctgtgctgggacattcttttcccatttaaccaggcttgctctgagcctagggatcagccataggtgaaagcttacagtcttctcaggatgtttctgagtgtgtatctttcctaggcatactgtgactttctaaattcccccccccccccacagctgcctttgaacgtcctaatttcccaaagcgtcaaaaacaattctattttaagactaaataatacttttcaatccttttatgtatgtaacagacgtttattcttctcttgctaacctgaagtcttctttgcattaaatttgacatgtcagagttgatcaacaatgatgaaagagtgagattaacactgtaaatggaatgttccaggggaagatagaatgaatcatagttcaggttctcattattatccacagatgatatagttttctaaagattctttctgcccagtcaccctctcctgtcttagtccctaatccaagcttcattctacttgggaaagagtatccttcttcaaaaaagaaaattggaaagactaagtaaattgtatcttttttttccctctctgaataatttacagtagctacttaatacctataggataaagaccaatgtctcaagtcatccacaatttgcgtcaaactaatgttcgaactagtttcacactcttctcctgtcttttgttttttgtttcttgtttctttttgagacagagtcttgctctgtcgcccaggcaggagtgcagtggtgccatctcagctcaccacaacctcagcctcccgggtgcaagcgattctcctgcctcagcaccccaagtagctgggactacaggtgtgcgccaccatgcccggctgatttttgtatttttagtagagacggggtttcactatgttggccaggctggtctcaaactcctgacctcgtaatccacccgcctcggcctcccaaagtgctgggattacaggcatgagccactgtactcggcctcactcttctcccgtcactcttacaaatcttatctgtaggcatgcagaccactcaccagttgctgcttcataaatttataatccactttcatttctctttgaagaactggctttggtttatgcagtcctccctccccaaaatgttcccttcttaccctctacctattgaaatgtttccagtcttcagggtatagttgaaatgcgccctctcattctgctttcccgaatagcatgttttctctcttcccttttctgcattagaattcctttctcttttatgcctccccctagcactgtgtttatgactattggagactcatcttttttccttgtttatgaaaaaggtcaatttctgcatttgtgtgctctacctcacaagtgtttttcactttttccaagggtttcattctgggacttttctttctcttgtatcttttccctatcaatggtttattctttttattttatttatttttttgagacgggatctagctctgtcacccagggtggagtgcagtggcgcaatctcagctcactgcaacctgtacctcctgggttcaagcaattcgcctgcctcagccacccaagtagctgagactacagtcatgtgctaccacacctggttaatttttgtatttttggtagagatggggtttcgccatgctgctcaagctagtctcaaactcctggcctcaagtgatccaccatcttcagcctcccaaactgctgggattacatgtgtgaaccactgcacccggccaatagtttattcttagcagaatatattctttaatagctcccataaagcaaacaaacccaaaatatattctcctgaccctacattcacttccaactatcaccctacatctacattctccttttcataccaaactttttccaagcagttgtctatatttatgtctccacttctttacctcctattcttgcttcagtatgcttcagttgagcttcgtccccctgtagtccaccccaactgctctttttttttttttttttttttttttgagacggagtctcgttctgtcgcccaggcgggagtgctgtggcgcgatctccgctcactgcaagctccgccttccgggttcacgccattctcctgcctcagcctcccgagtagctgggactacaggcgcccgccactgcgcccggctaatttttttttgtatttttagtagagacggggtttcaccgtggtctcgatctcctgacctcgtgatccgcccgcctcggcctcccaaagtgctgggattacaggcgtgagccaccgcgcccggccccaactgctctttttaaggtcattaatgacttccagccatcagtcctcattgctctaaacctagtagcagctttgtataacatgtacattggttgattataccctcctcctttatattttctaagacacaatttaacataacattcagtaaagtacacaaaacaaaaatttacagctcaaagatttatctgtaaatgaacacctatgtgattatcaccactttatgcttcctcctagttactgccccttcatgccattaaagctaatcatgatcctgaattttctgaaaatactcaagtatgcatcattaaacacttttgagttctgttttttcaatgttatataagtggaattgtatagtatgtattctttgtatctggtttctgttgtccaccattatatttgttagattcatccatgttgttacattggccgaagtttgttcattttctttggtgggtctgctatatgaacatatgactttatccatctgctgtcaaggaacgtttgtgttgtttccagtttgcagctattgtgagcagtgctgctatgaacattctttcatctgttggtgtgtatgacacaaatttacgttgcatatgtatgttggagtggaattcttgctctcaggatatgtctgtgttcaacttgagtaggtaatgacaaccttccaaggggttttatcagtttacactcctacccatacaaggggttttatcagtttacactcctaccagtagtacatgagtgatacctttgctccatatccttactaatcatatagtattgtcaatttttctggtgaacttatagtgctatcttgtgattttcatttgcatttccctaactactagtgtgattgagtattgtttcatacatttattgtccatttgatgcctcttctgtgagccgcctattcagatatccttcttattatttttattaaggtatgtatctgacatatttatttggggagttctttatatattctgaatgcaagccctttgtcagtatacatattataaatatatattcccactctgtggcttcgcttgtaactctcttgatagtttgcttgcttgctttgatggctagaacttcagtttgttttccttaattatgtagttgttttttatgtccttttaaaaaagtttttttccaactacaatcatgaagctaattcttctacatagtcttctagaaattatagtttcacttttttttttttttttttaagacggagtctcactctgtcacccaggctggagtgcagtggtgcgatctcagctcactgcaacctccacctccctggttcaggcaattcctcagtctcaacctcccaagtagctgggattacgggcgcatgccaccatgcccagctaatttttttgtatttttagtagagacggagtttcaccatgtcggccagactagtctcgaactcctgacctcaggcaatccgcccgctttggcctcccaaagtgccgggattacaggcatgagccaccgcaccctgccttttttttttttttttttttttttgagacagagtttcgctttttttgcccaggctagagtgcaatggcacaatctcagctcactgcagcctccgcctcccgggttcaagcgattctcccaccacggccagctaactttgtatttttagtagagacggggtttcaccacgttggccaggctggtcttgaactcctgacctcaagtgatccacctgcctcggcctcccaaaatgctgggattacagatgcaagctaccatgcctggcctatggttttactttttgcatttagatctacaacctacctggaatttatttttgtatatggggtcatagtttgttcttttcctatgtgtttatacatccaagcaccatttcttggaaaggtagtcctttgcctttatgatagtacctttctcctaaataagttgtccatatatatttgggtctattactggactgtgttttagttaattgtgctaatactatactgtcttgattgttatagcctgaaatctggcagaccaagtcttccaacattgttctttatcctttggcctttagcatttccaaatacagttcagaattgtgaagttccaaaagtcatttgggattttgattgagatggctttaaattataaattataggtcatttgagaatcaacattttatgatattatctaatccttgtaaactgcatatcagtccacttatttgagtcatctttaatttttgtcaataacctttcatagtcttctgagtgaaggtttcatacatctttcattagaattattcctgactttttattttttatgctatcataaatgacacatatcttccaaatttttattttctaactcctaattgctagtgtagagaaaaacacatgagttttgtattttgattcaatgtcactttcttttgattagtgttagcatggtatatcttttccctccttttacttttaacttttaacctatttgtatcttttttgaagtgggtttttatagaaagcatatagttgggttttgcttttttatccaatctgacaatatttgcttttttttctccctccccacacaaaggcagggtttcgcttttgttgcccaggctggagtgcaatggcatgatcttggctcactgcaacctctgcctcccaggttccagctattctcctgtctcagcctcccaattagctgggattacaggcacatgccaccacactcgactaatttttgtatttttagtagagacggggtttcatcatattggtcaggctggtctcgaattcctaacctcaggtgatccgcctgcctcggcctcccacagtgctgggattacaggcatgagccaccgtgcctggccatatttgctttttaatttgggtatctagaccactgacatttattgtgattatttatacaactcagtttaaatacaccatcttgctatttggcttcttctttacctatctcttatttgttcccctttacctctttttctgtcttctttgaattaatttttttttttttttgagacggagtctcactctgttgcccaggctggagtgcaatggaatggtcttgactcactacaacctccgcctcccaggttcaagcaattctcctatcttagcctcctgagtagctggtaatataggcgcatgccaccacacccagctaatttttgtttttgtagtagagacggggtttcactatgtttgccaggctggtcttgaactcctgacctcgtgatccgcccgccttggcctgccaaagtgctgggattacaggcgtgagccactgtgcctggccatgaattaattatttttatgattcccttttgcttttttttgttggtctgaaaaaaatctttagtaccagtattcacttgattgctcacttcagaaacccaggattatttttagtgtatttttctcccctatatctattctgtcataaaattctcagtttttctcttaaatatttctatactaaatcctttctttttagttcctactgcttgattgcttttgttcatgtgcttatctcttacctatgtatttgtaattactggtttccctttcttcacacttcaattatgatttaagactcaattctgataaaaagctttcagtggccctccagtgtttcttctagagggaaagtgcaggagacatgtgtaccaaataaaagtcttgatatttttattcttcttgtggcccacctttacctattttgcccatctccaatcacctctccacctcacattttacattcctgtgatactgatctacttactttccaaacatggtttggacaacctctgtgccttctgctctactggaaattatccttcaaatcttaacatttcctctgtgaggccttctttacttatctttggctgaattaggagttcctgcctctctaaatttttcagtttccatatacttcactagagcaatttatgaacagttggcccttgaataagataggtttgtattgtgtgggttcacttatatgtgtatttttctgaagaaatgtaccagaattttttttgagatttgtggcaatttaaaaaaacttgcagatgaaccatgtagcttagaaatatgaaaaaattaagaaagaggtatgtcataaatgaataaaatatatgtaggtaatagtctattttatcatctactaccataaaatatacacaaatctgttataaaaagttaaaatttttcaaaacttatgtacactatcacagactgtacacggagtcattctcaggaggaatgcaaaaaaacataaagatgcagtattaaattataacagcataaagtaaaatgtagtacatactgtactactataagaatttcataaccacctcctattgctattgtggtgagttcaagtgttttgagtgtctgcttaaaacatcatgtgacaccagttaatctctgcataaacagtttgtctttccagtaaattgcatatcacagtaaaaagtgatctcttggtggttctcgtgtacttttcatcatgtttggtgcaatactgtaaaccttgaataacaccatgaggcccatgcaaagtgccactagtgatgctggaagtgctcccatgaagcaaattcatgacattacaggaaaaagttacattgcttgatatgttccatagattgaagtctgcatccccatttcaagtctgttgccccatttcaagataaattaatccaatataaggaccattgtacaaaaagaaaaggaaatttgtagagccatcactgcagccgtgccaacacgcacaaaaactttgtacttttgcacaatgcctttttatctgtcatggaaaatgcagattttatatgggtacaggatttctataagaaaagcatacctgtagactctaatataatttgaggaaaaaaaaagtcattttatgacaacttaaaacaaaaggaaagtaaaggatataaagctggagattttaatgccagcaaaggatggtttgataattttaggaagagatttggtcttaacaatgtcaagataacaagagaagcagcttctgttgaccaagaggcagcagacaagttccaagatgcaattatgaaaattatttaggagaggctgggtgtggtggctcacacttgtaattccagcactttgggaggctgaggtgggcggatcacctgaggtcaggagttcaagaccagcttggccaacatggagaaaccctgtccctactaaaaatacaaaaattagctgggcatgatgtcacgtgcctgtaatcccagctactcgggaggctgaggcatgagaatcacttgaacccaggaggtggaggttgcagtgagccaagattgcaccagtgcattcgagcttgggtgacagagtgagaatctgtctcaaaacaaaacaaaacaaaaaaaaggacgaaaattatttaggagaaatgatatctgcctgaataggtttttaatgcagatgtaagtgctctactctgggggaaaaaatgtcacaaaggacatttattagtaaggaagagaagtgagcaccaggatttgatgccggaagggataggctaactctactgtttcgtgcaaatgtactcaggtttatgatcaggactgcccttatctataaagctcctaactcacgagacttgaagggaaaagataaacaccaactgctagtcttttggttgtgccacaagaaggcctggacaatgagaaacctttttctacactgatttcattgatactttgtccctgaagttaggaagtaccttgccagtaagagactgccttttaaagttttttgatattgtacaatggctctggccacgcagaaccccatgagttcaacactaaaggcatcaaagtggtctccttgcctgcaaacacaatgtctctaattcagcctcaagatctaggcagtcataaggacctttaaggcttattacatatgggtactctatggaaagcattttcaacacaatggaagagaaccccagtagcaagaacatcatgaaagtgtgagaggattacagcattgaaaatgccattattgttgtagaaaaagccatgaaagtcatcaaacccataacaatgaattcctgctggagaaaactttgtccaaatgtggtgcatgactttataagatttacaacagtcaatcaaggaaatcatgaaagagattgtggatgtggtggaaaaggttgggagtgaagggtttcaagatagagatcttggagaaattcgagagctaatagacaccacacaaaggacttaacagaagatgagttgatggagatgagtgctcctgaaccagtgccagaaaatgaggaagaagacatagaagaatcagtgccaggaaacaaattgacatgagataatctggcagaagggttctgattattcaagactgcttttgacttcttttatgacgtggacccttctataatataggcactgaaactaaagcaaatggaagaaggatagatatcatatagaaacatttttggagaaattaaagagcataacaaagtgagacagaaattaccacgtgtttccataaagttaactaagtttgcctgcctctcctgccttccctcctaactcctgcatctcttctgcctctgccatccctgagaagacaagaccaacccctccttttcctcctccaactcagcctactcaatgtgaagatggtagggtgaaggcctttatgaggacccgcttccatttaatgagtagaaaatactattttcttttccttatgattttcctaataacattatcttttctctagattgctttcttgtaataatatagtatgtaatacatatagcatacaaaatatgtgttaattgtttatattattgttaagtcttctagtcaatagtaggctattagtaattaagttttgggggagtcaaaagttatacatggggccaggcgcagtggctcacacctgtaaccccagcactttgggaagctgaggcgggcagatcacttgagtccaggggttcgagaccagcctagccaacatgatgaaaccccatctctactaaaaatacaaaaattagccgggcgtggtggcacatgcctgtaatcccagctacttgggtggctgaggcacaagaatagcttgaatccagcatgtggaggttgcagtgagctgagattgcgccactgcactccagccttggtgatagagtgagactctgtctcaaaaaaaaaaaagttatacatggatttccaactgtacaggggtcaatgaccctaacctccatgttatttaagggtcaactgtaattgaaattcttcatttttctattcctttctgggatatttcgtaagttccttgcagttcaagccaccttcatcttagatacacaataaatatttgttgaatgaaagaataactggataccaacagaggcttgtaggagttagtctatcatcatgtgatataaaactttacttttgatcattcatctagcacatatttattatatgtcaaatattcaacagccacaatgaaggattctaataagatttgatctttgccctcatggaccttatgggttataactgtttttccccagagtcacacttttagggataagacctgatatatgcaattttgaaagacaaagaaaatcaattttatgactcagcggttctttgcaggcattcacacaataaaaatagaaaaattcaagtggactagggaaaatattttctaagaagacatgtttcccccacgttgggtaaaaagaaaaaaattgagtttaatattaaaaattaaagtttacttataaaatacaggacatagagaaaaatgtacttctatttttcttttctataggagaagctaaaacttacttatgaggaaaagtgtgaaattgaggaatcccaattgaagtttttgaggtaaagtgaaatcgtccatttatagtcataccaaaagcataatgatcttaaaatatatttgaatgtttgctgaacttctagttttagtcattatcagacttacttgatgacattttaatacactttaaaaaatttcctcagattattaaaggatgaaaggcctaaaattgagttcttttccaaatcacgttcccatttcttcatcagttgtaaaatatttgtgttttcttgtagaaataagaatcacggccgggcgcggtggctcacgcctgtaatcccagcactttgggaggctgaagcgggcgaatcacgaggtcaagagattgagaccatcctggccaacatggtgaaaccccgtttctactaaaaatacaaaaattagctgggcctggtagcacgtgcctgtagtcccagctacttgggaggctgaggcaggagaatcacttgaacctgggaggcggaggttgcagtaagctgagaccacgccactgcactccaacctggcaacagagtgagactccatttcaaaaaagaaaaaaaaaaaaaagaaataagaatcactaactgctcttatagaaattatgatattcaagtaaaataatgaaaataaagcactttagttttcaaattattagtattttttctctgtagatagtcttcatctaattttaaaattgcaatgataatataatagtttgagtatttgtatacatgatgaatttgagtatatatgatgaatattcatgtactttttatagaatctatttattagagatcccagtaagacctatatattatagattaaccattagtgatttatgtataatgagtagaaaaagacagcaggaattaatatttttgttgttaaagattatttttaaatagtagtaatgaagtaattttaaatcaaataaactttgaaatattgtttataattttattttaataagtccaatttgaaattttaaaatcttccaggccatagcctatctagagacataactagagtaatactaagagccagaactcagctgattgtggtggcttacgcatgtaatcccaacactttgggaagccaaggcgggtggatcatttgaggtcaagagttcgagactagcctggccaatatggtaaaaccctgtctctactaaaaatataaaaattagctgggtgtggtggcacacatctgtagtcccagctactcaggaggctgaggcagaatcacttgaacccaggagatagaggttgcagtgagccaagatcatgccactgcactccagcctgggtgacagagggagactccatctaaaaaaaaaaaaaaaaaaaaaaaccgagctggaactcatagctttcactgtacatggttgtttattttttaaatgttcttatgtttttcatagattaccctgattagttttaggatttctcttagagatttttacttttttacaaagaaatgttaacatttaaaaaatactctaatttttgctttcttgttttttgtcctattttattttattttgattttatttacgacttgattctttagtttttaaagtgatgtatttctagatcattgtacttaagggaatgtgacttattttgtctcattcagaatccagatatttcatctttaattacattaaaataccaacttgtaatgaattagactttgttctctgaatccttctgtttcttcattttcttttactataatttaagattatttaaagaggcattttcataaataaataaaatcagtcttcttttcaactttctttttaactttctcttttgccatttctagtaaccaaatctacttgagtgttttgagtttggagctgaccaaaattagtaatggggaccctttgactttggaatgtgcttcccaagttctttttataaagcctttgaaagtcagacattccctacatgatattgaaaaagaaaacttatcatcttggtgttattattttggggatagggtagacgcagctcatttttcttcccctcaactttggaatgccattccaaagtttttttttaacccttagattgcctgtgggtcttttatgcctctcctgcgttgcttgaaagcccccaaaatctcaacagttgtctgacagccaggctgttggcttctcctctgtgacagtgagccagttaagatggccacagcacctgagcgtggagactttgacaatgacaacagagagtagacagagatggagataaagttcctgccttcagtagtctcatttttcagctagaaagtttttttttgttttttttttttttgaagtacaaaagaaccatctaggcaaggaagctcagttgccaaggtgactttagcgcagctttactgggataaggtaggaaaatacaacccatgtactagtcaattaatccttaaaaagtcaccttggagaaaaacctcatccagaggtgagctgataaagtaaaaacaaacaaaaactacacccacacccacaccacccccacccccaccattccccagccctttctttagcagcctgtatgtttccagctaatagctactacccctgaaatcttatgactggcaagttctatgtaacttccttctgtaacttactttcttttgaaacagatctttgtagaagtttgtcgttagataattatctatctaacagtaatgttttcctcctgaagaaaaatgggcagtaataaactagtcaaggataaaaatccatgtttttttatgtgaacttttaagacactctaaaaattttaagagattaatgcttgaaatagggtattttcctcacctcaagtatgttgtcttatattaccccaccccttttttaaggaaaatgatttgggatttatatttggagttttatttttgttttgtggttaatataacattaatggaggttggatcctgggacaagagagccagtgtcaggcggattctaatctatattaaaatcttacaagaacctaagctaattatgtaatttattccagtctcatcatattcaacgtgtcaattagaatcaccacaccaaagtttcagggtcgtggtaaaaattaataaggtattggacgtaaactaaagcataaggtgagtacccataaacgatagtagtagttaacattatgatgattcattttaaagtcatgtaattttacctggccattttctagaattttttcaccctctttttaggaacgacttagctgaatatcagagaacttgtgaagatcttaaagagcaactaaagcataaagaatttcttctggctgctaatacttgtaaccgtgttggtggtctttgtttgaaatgtgctcagcatgaagctgttctttcccaaacccatactaatgttcatatgcagaccatcgaaagactggttaagtaagtatgcttctacgcgcacggagactttggcaatatggaaaattctgcctttaaaggggcattgtgttcttctagccctatgctaagtcacatgtgattattgttaatcttcaaatacagtggattttaaaaggttccttcattatagcttccttgaagacaaatgggtgggttctgccatgtcaccatgtcactttgaacagaaaccatgccactttgaacagataatagtatctcttggtttcagtccatcttcaagtgagagaattgaactagacagttctttacgattctgtccagttctatgaatctatgattacaaatctaatactattcttagcaaaactgagtgtaatagaaattcctttggttttgccatatcttggatttttctgctgtacttcaggtagaatgagttattaccacatcttcatcatgtgtctgttgtaaggagtattataaggacccactgtatcccactattgatatttgagggttaactgagaacaagttacagatgaccttttgtgttgtccaagttttcgtctaagctgagtgaaacaattctcttcgtacatctgttttgttgttttcactattccagaggaggccttttcctgtgaaaattttattctgtggaaattgagaattattatgtaatatagaacccagtggcagtttatagtgtatgttcttccatgccccctacttttctttgtgctcagtgtcacctctctctatctgctgtgctcacttaaataaccccagatcacttccttttagaagaagtctctcatcagctctgccccattttgtcctcaactgacttaggttcctttcttctgtggtcattaaggtcagaccgattttgctccatgtcctgaccttcaacaaattccttttcttctctgagcctggcatcttctgttgtttggaggaaaatacctgcttcttcagatttaagacctttttgggattttactaaggcaggttagcctgtgaccagaagtactgcttttgaaactgactgcttgggttcatattctggttctactgccaacttaccatggaaccttgcaaaagttacttaacctttttgtgcctcaattttctcatttttaaaatggtgacataagtacctaactcatagagttaccttgaggggtcactagagaaaacctatatagtacttaaaacacttcctgacatatagtaaatgctcagtaaatattaaaaccattctgtaccttctatactcccaagaatgatcaatatgtcttctagctgtgatttccacacatggctaactcactcaggttgggggtgagttgctgttgttttcgagttggggtctcactcctttgccaaggctggaatgtaatggcacaatcatagctcagtgcaactttgaacttctgtgctcaagcgatcctcctgcctcagcttcctgagtaactgcggacatgtgccgccacacccagctaattaaaaaaattttttttggtagagatggggtctcactatgttgcccaggctgttcttgaactcctgtgatcctcccacctcagcttcccaaagtattgggattatagacataagccaccacacctgacctaacctactaattgttatatgaacatagaatttccagtgtggactgactggtagttttttatgtttgtttgttttgtttttgttttttgagacggagtctctctctgttgccaggctggagtgcagtggcgcaatcttggctctctgcaacctctgcttctcgggttcaagtgattttcctgcctcagcctcccgagtagctgggactataggcgcccaccaccatgcttggctaatttttgtatttttagtaaagacggggtttcaccatgttggctaggatggtctcgatctcttgacctcatgatccacccgccttggcctcccaaagtgctggaattacaagtgtgagccaccacgcccggcccgactggtagtttttatgacctatactgcttggttctgtttttgttaagtattttaagtattcaatatgttgttaatttattcatatagtctcaatataactattaaacatgtattaactattttcagatacaactaaaaaatgtagtaaacatttattatatgtcaacgactgtgctaggagatttaagaacatcatttttaaaaatcttcaagcgttcatgaggtacatattattacccccgttttatagctagggaaattggggttcagagaagttaaaaatttgcctgtttatatttgaaaaacaagaacagagctgtaccttacaaaaataaattcatggtagtttaaaggctcagatacaattcagactataaaagcattagaaataaatataaaaaatatcttataattgtgggttatagtcctaaggatgacgtgaaaagtggaagtcataagggaaaaaaagatacatttgtttctattaaaaaataaattcccttacaataaaacattacatattcagttaaaaggctgagaaaaaatatttgcactatacatgacaaaagaccaatagaataaatttcctttgaaacaaacaaaaaggacaagctgcctagttgcaaagtaggtaaagaatagaaatcagtgagcaataaaagaggaagatgtcagcatatgaaaatgtatttattctattagtatttgaggaaatacaataaaaaaattaaagaacaacccgtcagactgacaaaatagaacaagattgataatttcaagagttggtgaggtcatgagtacacaagtattttcactctgctggtgggttcataaattggtggaaatactttggaagtaaattagtcctgtccattcatattcaaattgtgcacttcacttttcaaaatctaccctcaagaaaaaactcaagtacatgcataatggggtatgtatagggaatgctttttgcagcattgtttataattatgtgaacaacctaaatatcgttcaaaggagagtaactaaacatggtttagataaactatgtcattttgtgcatagtatgaaaaacggaagtagttctatgtgtattaatgttggaccatctccaaaatatattgttgcaagaaaacaaaacaaaatggctaaagataaatctagtatgaaaccttttgtattttttaagtccatatacaaccatactacatttttccccttcgaggttcatagatatgcacagaaaaatatttgaaagtgtaaacactaaatatttaacagagataaccactagagaggtggacgaaggcaatgaaattgaaagggtgtcaaataggcctttaacaatattggtaactaattttgcaaggagaatataatttaaaaattaattttagaaagaggaaagcatattaaaagttgcaaataaaaagaggcagagcttaaaactaggtagtctagcaaaactaataagccaggcatagtggctcatgcctgtaatcccagcactttgggagcctgatgcaggaggatcacttgaggccaggtgtttgagaccagtctgggcaacatagggaaaccctgtctctacaaaaaatttaaaaattaaaaaaaaaaactcagccaagaaataacaagttattatgttgccttttatattatccttctagattatgaaaaaatatttttaaaggaagctataatgttttggttacttccaagcctggcagtcattcagaaattaagattcttgatcagttatgtattcctttgtctctatcctaaatttgagctcttagcctcttaaagtaaatgtcaacctacttagttcaattttctgccttgtcagcatatcattgtctcatgttctgcattaatgacagaaaggatattaaacctattaacactgagcggattctgcttttattgtcaatgaattcttcttctgtatcattctcttggcctaacttaactaatgcagagtgctgaatattgagtgctatgctaactttgaagagtgtccagcaccttttgggtttggatttctagttttatgtatagttagaagcctgccccctccataagctgttatcatattacctgaatgactttaacatggaatgtttaaaaatgataccttaaatatgataaatcaaaagtttccttgtaaatgtggtattgtgacagcagctttcagctcctttgttgcatcctttagcatttactattttgaatatatattcatgaaacaagaatggcttgatggccaggcatggtggctcacacctgtaatcccagcactttgggaggctgaggcaggtggatcagttgagatcaggagtttgagaccagcctggccatcatggtgaaaccccatctctactaaaaatacaaaaatagctggatgtgttggtgcacgcctgtaatcccagttacctgggaggctgaggcaggagaattgcttgaacctgggaggcggaggttgcagtgagccaagattgcgccactgcacttcagcctgggcaacagaggaagaacctgtctccaaaaaaaaaaaaaaaaaaataatggcttgtacagttgacaaggaggggatcaggcatgacttggagaccaggccacccatatgtttctggtggtttcttaggactcaaggactttttggagaatatacttaacaactattgatgacattggatatattttttatgttgatttgaagtcttcatattgtttccgacctttcgcctttcacttggcctctttatgccataagggaggtaagagtaacagtaacctctttttcttgcttaatgatcaaagtaccttcacatggtaaccaagatggaactgcttaaattcctttctgtagctcacagtaccttggagaagtttatacttttcaaaaaagagaaaagattccaagggtacttttctggggctttagtccagcttgtgattttggagtggatcattggcctgctctgcatagctggctttaaaagactacagcaggaacttcccagaaatgaggaacaaagaaatgttgtagtcagccttctagactttctttttaaaaacggtgtagtaacacttattagtgatacctaataatgcttaaaattaataataactggagtaatttagaaattataagacatttcttagccactccacatttcaaggtggagctcatgcatatacattagaccaactcttttgcttaaacacttggctgagattgttaagggactttctcagtccttttggccctgattgctgcgctaagtttcttaaatattacatgctcattagtgcgtgtaagtacatgcttttcaccccagaacactcatgatctttacgtcatctttctgcctcagctgctctttcatctggatcatggaatgttgcagggttaacacagtgttgctggctttgcgtcaagaagctccttgattacattcatcaacacattcacatggtgtttccaagcactcatagaacatttgccatggaggatggtaatttggagaactgccctttcactctcacattgatatgccacatgtgtctgtacagcttcccattgtgagagcctcattcaggtgtggctctgggctggacctgtggattgcgggatctagagcaggactgtagctaactgggcagttaccctgggtggctggaatcggctgtttctgaaaggcagattatataagtagcactgttagtcccaggggataagtgggctaaaaaatgaaagctcagacaagatgaagccagatggccacaggaatggagtaggaagcaaggccttgtgttgaggagaggggactgccagcccagagctctttctaaaaaaattatttgtggggttgcttgctgctatttgttatgtggactggctgagtcaaaacaaaaccaaaccaaaaccaagatttagtaacacctgagtgaatgagtagataatcctaaattgccaaaatgactacctacctgcaagcttcccaggtgggctcaaagctaccttgaagcatgcgttgcatttgccttacagaaaggaggagtgtgtcagcccagtggttacgtggagtttgagtgtaatcgttttgtggtctcactgttgaatgatgggcctaacaagacatctgtatattggagttttatctttgataattttctgtggttccatagtctaaatttggtgagttaatattctgaaacacttttgaaccagaacgactgaactctagtttctaattcaaaataggtaatgttttcagtttagatcatgaaatattagaactgagagggagctttacctcacctcttttgacaccatcctatagcagactctttattcatttatttgttttcttgttgtttattctgttgagcatctactgtgtgacaaacactactcttgacaagaggatattctgaaaatagataaagtctattaaacgtaagtttcccataagcagcaagtttgttagatttttatcctgttgtggatctgtctgtttgcatacttataaacactgagcttttttgatcattcttttttgagatggagtcttgctctgtcacctaggctagagtgcagtggcacgatctcagctcactgcaacttccacctcccaggttcaagcaattcttgtgcctcagcctcccaagtagctgggactacaggtgcgcactaccacacccagctaatttttgtatttttaatagagacagagtttcagcatgttggtcaggctggtctggaactcctgacctcaagtgatccgcccacctcggcctcccaaagtgttggaattacaggcgtgagccactgcgcctggccttttttgttcattctttttccttggaactttggctttggtgactgcatggtatcaggaacagataagaatctcattgaatagttacttttgctcttcattaagtcttagtgatttaagaaaggtgactgtaagatgcctatattgacttgctgtccttaaagagtgaatttttcttttcttttagaatcatagatcctaactggattgcatatccttgataaagctagaccccttttacgttatagaacttttatggaaatgcaaatagacacatattcaattttgctggtgtttatttttttacttaactaggataatttaatcttgccttgattcttccacttttttacatagtaattgtgtttgattatattcgattaaaacaatttacttcttttttcatttccttggaagaaaaattatttttatcaatttaaaacaaatcaggaaattctaaagtgaagatcactctgcttccatgaattttatatttgcagcaacttattcttttttaaacaaaaagggcttttatgaaactgctaataattgtaactttgttcagtattacatgtttcttcaaatgtggctgctttccaaataccacaaatagtttattttacctttaagagatgttttaaattgaatcattggttaattctgaaagtaattcaagcagagtttataatcctctacactatgactctttaaaacttgctaattaaaaaaaaatcatagttggcccttttctcatagtttagaccttggcaatgaaaaggaaactgcaagcatttatttcaaatgaatttgaaaccgtggtttagtcttcaactctttaacaaaacagggaacaccatatgtaacagtccagcatacattttttgctttttatgtcttgaaagtttcctgcctcactttctctttgtctactggatatttttattcagttgataaattgcaaatatcctagaatattttatatgggacttatttaatcaatgagattgtatccttgctattttacatgccagagcattttggcatttggttcacttctactcccaataaacagcttaggatagagtacttctgagaattgctgaagaagggtgggtcttggcaatgatcaaacccagtgggataagattgtgttaaattgtgaatgttatatgcatagccaggagattggaggagttcaacagtactaatcattgagcaacaacaagtgttcataagtaactgaaagaatgtaattgaaagagaagtgcaaaaaagaggattgtggagaaagataaaaaggaaaggacatatatttgttcaagtaaatgagaggagaatctgctgcatggacaaagcctcagtccttccttaaaatgttgactgctaccttgatttacaattcgtaccttccctactttgctgcatttttccttttcagcacctccccccacttttaaaaaactaatttgctcttctctgggctttcccctgcagccctctccacaatagatgattgtcccgcacagatgccgtcctgccacgaaggctcttagcctttctggctgctccgcccgccgctcgccaagtgaggacagagggtctttctctggggtgtgctttatttcatatgtgctcagccggcctaccctggctcttctaatacatattaatgcttttctctccctgacttatgaggacaggatcgtttgatcatttcttgttttgaatgttctttttgtgctgacagagaaagagatgacttgatgtctgcactagtttccgtaaggagcagcttggcagatacgcagcaaagagaagcaagtgcttatgaacaggtgaaacaagttttgcaaatatctgaggaagccaattttgaaaaaaccaaggcaagtctaataagatgcaaataaaagtgtctttcttttttttttcttttttcttctgagtatttatttggttattcttctataactaaactttgtttttcaaacacacaaagtgaattatcaatctgttaatgttgacttttctgaattaaacaaatttgctatttggagaattcttactgctctgcaaatactgttgttgtatcactgttcagagaatgtagtacagtataatactttgagagacctatatgcttaatctttttatttgctgataatttgcaatgctgcaaaaatcttaacacccaggcattagtttgtatgtgttcgtatatgactaaagacaaatgtttttcctcaataattgggaagttttgagaaaatccaaatataccaaagacaataatatatacatatttagtagcatttttttttttttttttttgagacagagtcttgccctgtcgcccaggctggagtgcaatggcacgatttcggctcacagcaacctcttcctcctgggttcaagtgattctcctgcctcagcctcccaagtagctgggattacagacacgggccatcatgcccagctaatttttgtatttttagcagagatggtgtttcaccatgttagccaggctggtctggaactcatgacctcaggtgatctgcccatctcgtcctcccaaagtgctgagattacaggcgtgagccactgcgcccggtcttagtagcatctttgagtctggacttactgtaaggtaactcaaacatacttaatgagaataacagtttatacttagtgatcggacggtgttataggcactttgaagaataggaggttactgttgattcattactgtatttgggggccacaccgtaatccgttaaagttgcatgtattttccctagacacactagcatacaattcaagttcttaatggccacgtgtagcaaatattggacagtgcagatatagagcattttcattatcatgaaaagttttgttggatagcactggtctaaaccatatatgaatctcagtgttttattaaaatattagggctacattactgagtatatgcccagaggaatataaatcattctgctgcaaagacacatgcatgtgaattgtcattgcagcacccttcacaatagcaaacgtaaacgatggaattgatggaatcaaccgaaattgacggaatcaatctaaatgttcatcactgacagattgtataaagaaaatgtggaacatggacaccatggaatagtatgcagccataaaaagaatgagatccgatcttttgcaggaacatgcatggagccggagacagttatccttagcaaactaacgcaggaacagaaagccaaatactgcatattcttacgtataagtgggagctaaatgataagaacttatgagcacaaagtaggaaaccacagacagtggcatctccttgaggatatagggtgggagcagggagaggagcagaagagatcactattgggtactgggcttaatacctgggtgataaaataatctgtataacaaaaccccgtgacatgagtttgcctatgtaacaaaccttcacatgtacccccgaacctaaaataaaagttaaaaaaaaattagggctattcaattctgcattaagcctcttgtcagccattgctatgtccatttgtctttatccagttcatccataactcttcccgtttgaccctcatgccttttgaaacttaggttcagttatgaccaaactccccaacatactgtttcctcagactctcctgtttcttcatttgttgtgagctctagctgtccctcaatgccatgtttcaaaaccttcagtgaaggcccttgtgtcagtcaagtcgtctcaggtgggtgtgatggaggaaaccgcagttacttcactcctgactgccatttccagggctttgttttggcacttactctcaggtcctattcctctttgaaattaagctaccgctctgtgttaatctgttttgcattgctataaagaaagagcagagattggtaatttataaagagaagtaagtggtttattttggctcatgttgtgcaggctgcatacgaagcatggtgccaacatatgcttctggtaaggcctcaggaagatttcactctgacagcaggcagaggggagcaagcctcacaagggagcaggactgagcgaggaggagaggggccaggccctttctaacaatcagacctcaggataactaatagggcaccaagccattcatgagggatccacccccatgacccaaacacctcccaccaggccccacctccaacactggaagtcacatttcaacatgagagatttggagaggacaggtatccaaaccatatcacactcctctttgaaatcagtgttgtctctctcctccctaatcaataaaatctctcaattgagaaggctctctttgaccctttctattttatttttatttttattatcatttttttgagacagagtttcattcttgttgcccaggctggagtgcaatggcgcaatctcagctcactgtaacctcagcttcctggaatcaagtgattctcccacctcagcctcccaagtagctgggattacaggcatgcgccaccatgcctggctaattttgtttttttagtagagacagggtttcacaatgttggccaggctggtctcaaactcctgagctcaggtgatgcacccatcttggcctcccaaagtgctgggattacaggcgtgagccaccgcgcctggcccctttttaaaagttttaacatctgatccttttcctcttcattctatctctttcatcatccttaaatgtttgaatttccatgttgctgatacacaaaacactaatactcttcagcttccttaactctactatatcccctacttctacgctaacatcctgcatgaactgaaatgcccctaagatctctctgaaaccacactctctgactagggcctttgctcttctttcctccctatcaaagttaaatctactccatgtcttcattttcacctctagttcttcagcattctttctttttatctctcattttatctgttgtgtccaggctggtcttcttttcttcccatttaaacataaattttaccatctcaaattgaactcacacattcactctcccaaatctgctgccccttctgtattctcttactggatggcacttttactcactaacatgctctgatcagaaaactggatttcaccctgtccttcacccctaacttttaaccagtcactaagtacagatctgagtttctaacgttttcttgaattctttccctcattaacacttttcttatggaagctaagtaatctctggatttatctattacacttcttcctagcttgcctccctccttcgttccactccctacactgcagccagaagcgatctttcttaaagacacatttgatcatgtgactctgatttaaaattcttcggtgaattttcactgccttcaagacagtctccacattctttcccatgcccgtggtctgtcctaatgtggctcccttttgccctccaaggctgctgcttttttcctcctctcgcgccctgtctcccagtacactcagctatcgtcaaaggcaggagggcttagggggtgaacatgggcttactagagttagccagacttagattcaacttctggccccaccattcactggctgtgtgaccttggacgagttactttaacttctctgtgccccagtttttcctcatctgtaaaatggagaaatatgtgactcctaggattgtgaatgaggactgcattttaaaatgtatattggttatcttatacaaacccaggcaggcacaaaatatttctcaataaatagcggtggtggtgataaccctgctgattatcccatcctctctccagcctctgagtctttgtatgtgccatgtgcattcttctctgctccactgcctgtatattactttagccttacttatcttagcctacatggtactccctctaggaaacctcttatctcttctgtctagattcgatgtaccctttatatgcctttatagcagggtttttcaaccttggtgctattgacattttgggctatgtaactctttgctttggatgctgttctgcacattgtaggatgtttagaagcctctacctactcaatgctagtagcttaccctcctcccccaagttgtgacaactgaagatgtctccatacattgccaaatgtcctctggtgggcacatttacctccatttgagaaccactacttatatagcatttatcaaaatgtattattattgcttgtttgtctgtatccttcattaaacttttaaaaaaatatttcagcttttagttttgaaagaggggtacatgtgtaggattgttacatatggtggacccaggtattgagcatagtgccccataggtacttttccagcccatgcccccctctctcctcccccaagttgtctgcagtgtctgttgctgccacgcttatgtccatgtgtacacaatgtttagctcccatttataaatgagagcatatggtgtttggtttcctgttactgcattactttgcttaggattatgtcttccagctacatctatgttgctgcaaagcacatgatttcattcttttttatggatgtatacattccctggtgtatatgtaccacattttctttatccaatctgccatttatgggcacctaagttgattccatgtctttttttttgagatagaatcttgttctgttgcccaagctggagtgcagtggtgtgatcttggttcactgtaacctccgcctccagattcaagtgattcttctgtctcagcctcccgagtagctgggattacaggtgtgcaccatcacgcctggctaatttttgtgtttttagtaaagacagcgttttgccatgttggccaggctggtattgaactcctgacctcaagtgatccacccgcctccgcctcccaaagtgccgggattactggcgtgagccaccatgcccggcctctatgtctttgctattgtgaataatgcagtgatgaacatttgagttgatgtatctttttggtataatgatatatatcccttggggtatatacccaggaatgggattgctgtgttgaatggtagctctatattaagttctttgagaaatctctgttaaactttaaaattgtcaccaagccaagggcttgcttccctatgcacatagaagccaatgctacggcactggcttttaagaaaagaaaaggctttattgcaagttgactggcaaggaggcaagaggccacactcaaatctgtctcctcgttctgcggcaagatcaggaagattggtttcagaggtgtttctaagtagccccaggtgataccagtgcagccagtctgccagggtggtggtaatcacaatgaggaggttaaacctctcatgtaccccagaaatatatgcatctactatgtactcaacaaaaattaaaaataaagtaaaaacaattaggaggttaaagctttttcccattgcacatgcctggactacatgacttgcaattttggctcagtgctatctgtaacaacttaaacaatggttaatcagtctgcactagtcccttggttacaaaatctctggtgttacggaatttctccaccctgatcactgttaaatccgtagcatcttgcgtagatctcaacacataataaataggtactcagtaaatatccactgaggaaggaaattgcaactcagttctcactagcactctacagtgcctttattcttatctttccagcttacctactttgccagcaaaagtacccagtgaaaattaggcccaatcacacttttttttttttttaatagctagttcaagcctcccaagcattgctaaaggaagtcatttaacaaagccacttaatagccgggcgcagtggctcacgcctgtaatctcagcactttgggaggctgaggcaggcagatcacgaggtcaagagattgagaccatcctggccaatgtggtgagaccccgtctctactaaaaatacaaaaattaactgggcatggtggtgtgcgcctgtagtcccagctactcgggaggctgaggcaggagaattgcttgaacccgggaggcagaggttgcagtgagctgagatcacgccactgcactccagcctggcagcagagtgagactccatcttaaaaaaaaaaaaaagccacttaatgagttccactgaagagtaatactagtcaccttcagtggttgtaggtactgttgaacaattcttttctctgcagttgaagaccttatatactctagtcaggaactccactttcctcacttttccaactccactgctggcacgtcactttcttcggatgacctacttctcactttactaagattaggaccaactgacaagagcctcctcagcatcttctcatccctcgaatgtctcctctccttatttctcctttcttttctggccctcttatttcccaagatgaacatctttctccccgtttttgatgtctcccacttctatgtcatcacatttttcttgcatcctttatccttttctctccactgtttttccccctcatcctgcccacagcctttgtttaagtaaacaaaaagcagctttcctgtgatcatctttcacttcgtttattaccgtccattcctcatttcactggcagacatctcacaacagttgtccaccctggtagctttcctttcacttctgagtgcatcgcagccaggctttgaacaaactgtagcctgattttatgttactgaagtgctcgcttcatgatcactggtcacttcctgattaccaaacccagtgacctcatctcaatcctcattggacttaaactctatagatttggaaccctgttaactggcctatcataacataccatctctttcccttgatttagctgatatgttactctcatgggtccacattgtaccattcttgtctactcttaagtctcttttaacttgtttcttggtttccacaagtcttaagtgtggacgttcctcagagttagttcccagccctcctcccatgttgccttgacttcctgggattcatttctcctcacgtggccaaatattaccagtgaatacacccacattatgcctttagctttaactgctctcctgagccccagccctacgtgttttgctgctactagatctttttttatggatgatacactgctggcgtctgaaactctacacaaccaaaccgttcattggctccgccttcccatctaccactccttttctttctaccattttctctatgatcgtcttcaaacaaaggcatcaccatcttcaccgcagtcctggcttgcattctttaaaacatctcggttcttccctatgcttgctcttgacattccatcagttcccaaggtctttctctctctcttcagagtcaaatttctatttaactatgcctaccttttcattcttataccactgccctggttcaaggcttcacatcttcacatgctttttttttttttttttttttcagagacagggcctcactctgtcacccaggctcagtggtgcggtcatatctcactacagccttgcactcctgagctcagctgattctccctccttagccccgcaaagtgctgggattacaggtgtgagccaccgtgtccagtggtatacttcacgtattcttataccaagtatgcagacaattacaatagctttctaattggtttccctcaaatttcatctaattccagcatacttttcacagtgctctcataacatttatagttcctgagttataaatctccctgtttaggtagctcccctcttgcagtagaataaaagacaaatctggccccattctaactttgctagtcttctctttcactctactctttcatgtcaccttcactgtttccagaacatgacctgcagttggccattttcattgatttgcacatgctgtatttttctgccttgtaataatctatgaagtatctgttcaatctatgaggctcaactcaagtggcagtcttcctgaagttttccccagccccttcttgtttgaattaacttctttttcctctgtattcctgttgatgtggtgtataattttggtagttgtttacacagttttctccaccagaagaccttgaaatcaggtctgtgacatctatcattgtatttcacacatgaccatttacgtcttaattaacaataaatgtttgttcagtggaagtcaattattattaatgtgaaatttgtaattaattttttaaaaaatttaataactgagagcaagcaacactattgttcattaggaatctatagcattttcagtaaattagtaataatgaatgcaaggacaaaatgtattgcaagtctagtactttttatctagaaggtatgttgaaacacactagaatttttgctttctaagtgcattaaaaagccaggtggtatacatattttaatttaaaacccaactacttatattactgagtgatgaaatggttacttggtttagttccttgacgtttgttgccatctagtgtggcatttgggtatcacatgctaaatagaaggaattatatatttacattctttgtggcagtgaaaatgcctgaggattttataagaaaataaatatataacttgagaagtatataatgccatgcaaacattcttgtgtggaactaccttggataaactccctactctcaccactttctaggtctctgatttgggcaagttactgaatgtctcaaagtaccagtttcttcaattgagtgataagaaccaattaaaatgtattgagagggttaaataatccatgtataccacttagcaaagtatctggcacctagtaggtgctcaataaatatttttgtttgaaaatggaagttatttcaattggtgataattttaaaagaggaaaagaattcacctgggactaaatggagagaaaaagtagaggcttgtgcagtcacaccttgataaaaagctacacgaagcagatgaaaaggttaaccaggccttaggcctgcctgcttgtgttggaagggaaattgttgagaggtatgtgtaaaggcctgaaggcacaggctgtggcatgaagttaccataagcatatctgtaatgatataaccctctaaggaaaaaaaaaattttcttttttactcataacaacttgaacaaagtatgtatttccaatttgctaagacctatcctgccatatatctttgtgggtaagtggtgtgaactttttaaaaaagttaattattatgtatacataataattgtacatatttatgggttacatgtgatattctgaagattagtttttaaaacagcagcctggtaggttgaacaaatatttacaaagactttttctcccttttcaaatatccaaattattctgtttcttggattacagggagtcagaaaggcaggaattagaaacctggattaaaaataaaatcagaaaagcattgactatttggttatagtcacaaggatagaaaataacgcttcttgatttgcacattatctgtcccaaaagaagtgtaaatatcttgaaaaatggtacatagggatagactgataaatttctggttagcaagggtttataaattaaaatcaatagtttgcattattcataagttagatgtttgaaatgtgttaatctttttaattttgtgggctttattcataaaaataaaaatgtttgtaagctttaaagtttatgttcaaaggtgtgagctgtatatttttcataagatcttaattccttagttatgaattattctgtcacaaagatttcttgaaaactaaccctagcagttgggaaggacttttatatgatctacaataggtttcctgttttaaaattttagttgactagatataaattttgttttcgaaaatattttgactgcctaagatagtagtgcctaccctttggcttaataaaaccaggactgggaatatcaagtccaataaactgtgtttgaaaaaaagtgttaatatgtcaacacagaatgaccacagctaaagaaatttcccagaaaagaaaaggtaccttcaggaatgagtctgctgggtggggggaatgtataattccccaacttctcaagacctacagccatttccaccaaggaaagggccgtgttcagggaaagggagagaagccaggacttgggaactactgagagaaataacagccgcaggccccaaattaactttgtcacctataaagatctatcatttaatggtaattgcctgtttatagcattcagttactataaaattataatttataattttatagaaattaaaattataatttataattttatagaaattaaaattataattataattttatagaaattaaaattataattataattttatagaaattaaaattataatttataattttatagaaatttataattttatagaagttaaaattataatttataattttgtagaaattaaaattataattataattttgtagaaattaaaattataatttataattttgtagaaattaaaattataatttataattttgtagaaattaaaattataatcatttgatgatagttgattgtttactgacctagcctttgagaagtcagttattatgtctttactgaatggttataggggtactcaatcgacagggattctgaaactaggagaagaaactctagaattaagagagagctttaatggagatagtgtataaataattgtttactagacccaaatcttttagtatgtgcggtccagtgtgagagagttatctttagaaagaataaatcatttttctgattccaagtgttactacgcttttctgttttcttcactgtgaccggacatatacgttaaaatcaaagcaaataaaagtaaaagctatttttgtttgtttgtttgttttgtttgtttgtttttgagatggagtctcgctctgtcgcccaggctgtagtgcagtggtgcgatctcagctcactgcaagctccgcctcccgggttcacgccattctcctgcctcagcctcctgagtagctgggactacaggtgcccgccgccacacccggctaattttttgtgtttttagtagagacagagtttcaccgtgttagccaggatggtctcgatctcctgacctcgtgatccgcctgcctcagcctcccaaagtgctgggattaaagacatgagccactgtgcccggccttagaagctatttgataatatggaattgttggttacacgctaagagacatcagtaaccagttttttgtttgtttgtttgttttgtgtgttttttggggacggagtcacactctgttgcccaggctggagtgcagtggcaccatcttggctcactgcaacctccgcctcctgggtttaagcgattctcctgcctcagcctccctagtagctgggattacaggcacgcaccacctggctcagctaattttcatattttagtaggacggggtttcaccatgttggcctggctggtctcaacctcctgacctcaagcaatccacccgcctcagccttccaaagtgctgggattacaggcgtgagccaccacgcccagccaataaccagtttttaacctaatatttttattcagtgttttgttgcccattactcatcatcagccattggtggtggccattcctaatagagagaagaccatccacaaaaccaaggcctcagcagtggttttgtttacatgattttacagcttctcactttgtgcttttcactgtatcatcctatcttggcattacacctcttatcctgccaggattatttactgttgcttgttctttagttgactgagttctttgaattgattctgtaggtgcctttcatggtagcctggttttagatcttcagtctcttctgctgttcctatacttaatgatgatgactcctgagtttttgttcagttgaaaactttctgattggatatattggtttatattaagtaagcgttttgtctattcataccagtagcattcatgatatcagggagagttatgaacatttactcaattcatgtgaaatatttttcacaagagcaattacattttgaatcacaaaagtaactcattcatatttcaagctccaagggcttaaattatagaaaaagtatgccttttcatttattttaatatctaatttaaaatttccttttccaggcattctcggctggaattttgacttgggactaattccctagaagaatcactttttactcattgtatttgtttattagttaatctgagacaactgaattttacctttatattttatgcctgggagcatagaaacttttcagaagagaccaaaagaaactggagtttaatgctttccagatgaagagaggaaaattcacatatcctagatatttattgtctgtatttattatagctttcaccagagggaagcataactatgcataaaacttacagtgcttactaaggccatttccatctccattaaaatcaaatgtgactatgaaatttctaatcatacagcatgtaagtcacatgagacctggggttctttctaccatttcaggggaaaagagaggttgtgtgaggtggatattgtacataagggccactggaataagactataagatactatagtaccttacttttattaggatttttaaaaattgggattttactatgcaatctgtgtatgtaactaaattacatttgtaccccatatatttatacaaaaaaagacctccccaaattgggatttttgaagtcatatttcattattgggtgttataaataaagatattgtaaaagtggccaaaatgaagttagagattttttatttctggaaatgcagagtgggaaatttacagtaaaggacaatcatgaactttaccagaagtggaagatccttataaaactaagtagtgaatactgtcttgagtctttccatttaacttacgattattacataatttttacttcagttgtatgtttaaggggagtgaactaaattttctcttagttatatttaaggaaacttgattattatatagtattaaacaaaagatgcctgtgtgtaatgatatattcaacatttcattttagtattttgatctatcatttgaagtattccaataatttttatccatgagcaaataagaaatcagttaaattggatacttacgtatttcgtgtagtataaacatgatatataattgaaaatattagaacacttggtgtttctggttcccttttttaaaattctgactcatctgtggccgtcatcaaggttcattacctgaattttgtcattgattaattaatatggctttaatcatgaaaattgaaatatgtcaataaatgtaacatttggatactcttttaggtcaataagtggtattgataaacaataaaaaattattctaatgggctttatagtgagtttttgctattttaaatatacttaaagcttaattatgtcattttacctatattttttccaaattctaacctcctctttcaatctgttctatcctggcaggctttaatccagtgtgaccagttgaggaaggagctggagaggcaggcggagcgacttgaaaaagaacttgcatctcagcaagagaaaagggccattgagaaagacatgatgaaaaaggaaataacgaaagaaagggagtacatgggatcaaaggtacttaaggactctgctgttatccacattgcagaagaaaggttttttatgatgccattgatgattccataggctggagttcttgaatgaactttaaattttaaaatcgttattatataagtagttaaatttcgtataatttagaattcataaaaatgttttatcttttcatatatttctcaatagtttatgctgatcttttcaaataaaataatcagttagattccatacaatgaaattacaaaatttactttaaatcctgccattctgttggattccctctctcgtgtttcccagagtcgtgctatgaagatacccagattttatttcaaccttggctaaatcaaggagagatgacttcccctgcattatctcctacccctaaattaaatatgcagaagatgaaacacttgtaaggaactgagtaaccaagaaaaagtgattatgcactctgtatgaaatcagttctgacaaattacatgatgaataatgacggtaaccagatgaagggagagatttaaggcaaaaggaacagataacatgaaacaagcagtgtttgaaaaggagttcacaaactagaatacagagttgagtgggacctagctttaaaattgctaactagactcgaattgagcaagttgtggtccatcaagtaaccaaaacaactgtgttacatgtttgtttttaaaagtggactcacagcttgtactctaaatgctatgttgttatcagattcaatgtgtgataattaacttattcagtaagtatatactgagtatgtgctgtgtgcaaagcaatgtggaggcctaaagatatgtaaagagaaaaatcacaacttctgccctatgagttttaagtcttaataagagtaaactcaggcatttcctgtaaatgtccttgtcttcttatccatttttaaaaattgtgtctgtcaaaaccctactacctaccttctctgccctggattggtgatctctgctggtaaaaatcacacagccttgcagatgacatggctgtagactccaggtcttcggtgtccacggtcctttcagtgctttctagcagtcctcttttgccttcctctctcttattcattccacactcaacagatattaaccagaggggctgggaatgttgtagtcacaggaacgatgcagtttcctcatgaagcttacaaactcgtaggagaagtagatgttacacaaatgttttcataagtgagttttcgatcatcattgtgataaagccataaggttcggtttaggatatcgtgggaatgtgtaacaggaatctgaccttgtctaggcagtcacgaaagactttcctgagtaagagatgttgaaaatgagacctgaaagcattgatgaatggacaggtgaagaggggaagagggtttcaggcccaggaatataacacacccaagactctggacctggaaagcatcgcactttctaggaatttggagaaggccctgatgggtggagcatagagagagaggagcagagtagtgggaatgagtttggagaattatgttgggatggaatcatgaatggctttaaaatccatatgaaggattttcaattttgtccaaaaagggatggaaagccattgaatggctttgaatttgtcagtgtcacgatgccatttatatttgagaaaaatcattttgtcagtggattggaaggagaagcagaatagatgcctggagatcagctggaggtcattatcgtagtccaggtctggaggtgactcacagtccaggtctggaggtgattatcataatccccctctggaggtgattatcataatccagctctggaggtgattttcgcagtccaggtctggaggtgattatcacggtcccggtctggaggtgattattgctgtccaggtctgcaggtgattattgcggtctcagtctggaggtgattatcacagacccggtctggaggtgattatcgcggtcccggtctggaggtgattatcgcagtccaggtctggaggtgattttcgcggtccaggtctggaggtgattttcgcggtccaggtctggaggtgattattgtggtccgggtctggaggtgattatcgtggtcccggtctggaggtggttatcgtagtccaggtctggaggtgattatcgtggtcccggtctggaggtggttatcgtagtccaggtctggaggtgattatcgtagtccaggtctggaggtgattatcgtagtccaggtgggaagtgatggtatcttaaatgcatttctttaaagactgtttcaaatcacttgttcttctcaaattctctataataccatttttcctcttattctcagcagagagccttacttaactaacaaagaaaatggaagccgttgggtgatgaccacctcaactatttctcttgtccatgccttaaaataaattttcacctgtattccaacccagtctgaatgggaaaggtgtcttcctaatcccttccccttcccatggacctcgtctcctttcaccccctcaaggaactcattccatttgtttgttccacttttctgaatcaatctttccttcactacagtctctttcttatcctcaggaaaatattttcagatgtctcttactgttgaaaggaacaatctttcttctaatctgtggttcttaatttttggcacgcaagaagttctaaaaatctgattgtccaaacagtaccccacacccattacatcaaaatgtctgagagaagcatccaggtgtcagtgtgtttgaaactcacctaggtgattccaatgtgcagccaaggttggaaaccacgtcagtaattccatctccctctttgactctttctcttaatagtcgagtttcttgaaagatttgtccatacatgttgtctttattttgtcacctctcacttactcttcagcccactgcatttcaacttccatgccacagccagtgaaattaccattgctatgttcactgaagatctgtttacactatatttactgattttttttcagtcttattctccttaaaagattctctatgatttctttgaattcatattcttgatttgggagaatgatgatgtgtgctttttacattactctgagtttaaagtgcctttgagacaataaaggagacacatccagaaagcagcttgataggaggttctggagtttagcagggagctaaagatttaggtgtctttagcagtactatagcttgaattccatgtatatatagccttaggacctaaagcttcaagactaaagctatttgatttctagatccttaactgtatactgagctcccaaaccagctttactttccacctcctatcccagtggatccactatttatccagttatccagcacagaaatcttgtcacccttttctcccccgtctttctcaccccacacatctcatcatcaccaggctctaagacttaagcccctgagcatttacattgccttgtctctctatcctactgctaccatatctcatccttggatggttcctatagcccctgtggtgtccttgcctccagtctcacctccttcctatctgttctccaaactgcagctgggatgatctttctcaatatgtcagtctcttgctttaaaactcctttcacgtctccctgcaaccttgaataaaatttaggatcctttatcatagcatgaagactctacaatattgttcctctctttggctctccggtcttatgttccttcatttttcttctttgcaccctcaccacactgacctacttgtgcttccccaagcatgtacatatgcctctcttccatactgttttttccagtgcaggatattgcatgtgctttgccctctgcctagaggagtcttcctctgccctctttaactgattcttcagagttgtttgtttgtttgtttgtttgtatttgagacagggtctcactctgtcacccaggctggagctcagtggggtgttcacagctcacttagcctcgaccacttgagctcaggtaatcctcccacctcagcttcccaggtagctgggactagagaggtgtgccaccatgcctggctaattgtgttttttatagagacaggtttttgccatgttgcccaggctgatcgcgaactcctggggtcaagcaatgtaccctccttggccactcaacgtgctaggattacaggcgtgagccactgcgcgtggcccagaacttttcttggtaccacctcgtctccgcgcctcccatagctgaattgggaccgtctcctgtgggctcccatagctcacttcattacaaattcatgtcgaatagcttgcctcccctagttcagtgagtcccttgcatgtaacatcctcaatgcctggcacattcctctcatgtaaaatgtgctcagtatatattagatgaatgaaggaatgaattacaaggaaaagaaaaaagtccctatgccattgggaagttatggctaaaatgctgagagttcagaggatcagaactgattgtctgcaagagatcatggaaggctttggggaaaaaatggcattttcgttgagcttccaagaatagatggggtttagaaacgcagagtatgggggaaggaacgccacctgtaaccaatatgaataagacatggaagggagatgaagttgcgaattgagtgttgtgtgagagagaatggtatcaatagcaaacaccagctattgttcacgcctaggaaatttgtattttttggttgtttgctggaaaccatttgccttgctgagtagttctactgtgtagaagtatgttgatgagaattcctgataagaaaggaaaaacgaaggctgaagtgtgcctggcagtattccaggtgccttcatatgtaacagaacctctcttttactgacagttgtttcatgaataaaggtggtgacagaaatgcagcacattttttatgtatcatttatttatttatttatttttaacttttagattcaagggagtacatgtgcaggttttttacttgtgtatatcgcatgatgctgaggtttggtttacaaattatcttgtcaccccctacataagcatagtacccaatagttagtttttcaacccctaccccactccctccctctcctctctagtcatccccagtttctgttgttgctatctttatatccgtgagtacctaatacttagctcccacttgtgagtgagaacatgcagtattggattttctgttcctgcgttaattcacttaggactacggcctccacttgcgtccatgttcctgccaaagacctgattccattcttttttatggctgcatagtattcagtggtgtatatgtaccacattttctttatccagtccattcttgatgggcacctaggttgattccatgtctttgctattgtgaatggtgctacaatgaacatgtaagtacatgtgtctttttggtaagacaatttgttttctgttgaatatatatccagtaatgggatttctggtagaatggtaggttctaagttatttgagaaatttccaaactgctttccactgtggctgaactaatgtacattccaccaacagagcagaagtgtccttttctctgcatggtctgttgttttttgagttttgaataacagccattctgactggtgtgaaatgggatctcattgtggttttgatttgcatttctatgatgattagtgttttagtctgttctcgcactgctataaagaaatacctgaaactgggtgatttataaagaaaagagctttaattggctcatggttctgcaggctgaacgggaagaatggctggggaggcctcaggaaactttcagtcatggtggaagggaagcaggcatgtcttctgtggttggagcaggaggaagagagagcagggggaagcgctacacacttttaaacagccagatcttgtaagaactcgctatcatgagaacagccagggggaaactgccccgacgatccaatcacctcccaccaggcccccctccaacatcggggattacagtgtgatgtgagagttgggcgggggcagaagtccaaaccatatcattcatgagtgatcttgagcactttttcatgtttgttggccatttgtatgtattcttttgagaagtgtctgttcatgtcttttgttcattttttaatggggttgttttctgcttgttcaattgtttactttctttatagattctggatattaggcctttgtctgatacataatttgtgggtactttctcccattctgtaggttgtctgtttactctgttgatagtttcttttgctgtgcagaagctctttggtgtaattaggtcccacttgtcaattggtgggttttgttgcaattgcttttgagaacttagtcataaattctttcccaaggcccatgtaggaaacacccggaatggtgtttcctaggttttcagctaggatttttatagtttgatatcttacatttaaatcttcaattcatctagggtcaatttttgtatatggtaaagggtaaaagcccagtttcattcttctgcatatggctagccagctatcctagcaccatttattgaatagggaatcctttccccattgcacatttttgtcaagtttgtcaaagatcagatggctgtatgtgtgtggctttatttctggatctctattcgatacaatacatatctgagctagagtcattgaagttgattttgtccctagtaagccctggctgacatttgatctcaagatcctgctctaaataaagatgtatgaataaagagctcacagtggtcctagcactgaggtcccagctctcaccaggaaatggcagaaagtggttttggagtaaaaggatttagagttgaatccagcttgacctttctgtgaccttgaacaattcacttaacctctctaagtttcagaggagtaaataaagttaataatacatcaagaattgataggattaagtgagataatgtttagaaaatatctaatataatgtctgacttaccgtgggcatttaataaattttagcttgtggctgttgttttagagaaagagagacggagccttcttggatagatttcttggcccttcatgttagtaaaagcagacagacttttatataaagcccagctttaccttttacttattagtttgaatgaacttgggcaagttacttagttttctgaatctcattttttcaaatgaaaattaattccatataattccttctctaggggatttaattattattagagacagggtctcactgtgtcacataggctggagtgcagtggtgtgatcatagctcatcgtatcctcaaactacttggctcaagcaatccccctgcctcagcctcctaagtagctaggactacaggcgtgtgccaccttgcctggctaactaaaaaaaaaaattgtagaattggggtctcattatgttgcccaggctggtcttgaactcctggcagtcctcctgcctcagcctccaaaagcagtaggattccaagcatgagccacagtgcccggcctttctaaggggatttaaagagagaatgcatatcacactgcctggcccaagaacataatgactgaccagttaatcataacattgtaagtgctaggcagttaaagttagtgctagaacaagaatctctgctttcctaactgtaggaatacttgtgaaacgtatagattttctttctttctatgttttttttattcctcccttacttttcttttttttttttttaaattccatttgtgtgggaagctgtcggagaacagatgccttctacctagacaggtttgaatcattccccatcaacagttcttgctgtgagtttgtgtgttatcttcaataatggtccttggtgttgcactgagcactcagctttgttacttcattcagtcattgatcatttatttattgagcaccccctgaggtccacacgttttctcaattgctttccttgacagtatccattgttaaaatccttaattcttgtatctcttgcatagggagtacagcttcataccaggttcaatacactagggactgctctgcagaaatttctatcagcctctcccaacctgggtgtccttgtctcttccttgcccctgtcaaagtttaaaggactcacctgatgtcaacgtcctggacatccagcagtgttgcagctgtgtctgtgttacttctggctctgcaacagatgtggatggagaagctcctgccgtgtaatgttgacttccagatggtgggtggggaggaaaagaaggtgtgacaacaggaggggagacctcagaaagtggggtgggcggcaggagggagcagacagctagtgggcagaggacctcagaaagtggggtgggcggcaggagggagcagacagctagtgggcagaggacctcagaaagtggggtgggcggcaggagggagcagacagctagtgggcagaggaagggaatgatgggtggcagagggaggaatcctaaggaaggggagagatttgtgacatgccttagaagagaaatggactagaatttataattagcaaaataaatgtcggtatatttacttcaaaaaccatacaatgttgtttaccatcagttatgtatgtccacataaataagtaaaatatgatttttagtagctggtaattaaagtttgttcctgtcatatggttccagaaaagctataattacacattcataatatatatgctcatgaactcgaaattttaaattgaaatgaaattgatatttttgatgttatatttaacttcttttcaaccttagttttatattgtaatgtgcccaagaatattttttagtttgttattagtaaagctaattgtatgtgaaaattagatttgtagacaatcctttgatgatagggatgtgtaaaaaaccataagtcaaatatgaaattctccactaccttcagaaagttaattaatatatctgcctaaattattttcatagggtcaactttaactagttctgtagttcgaaggcagacacctatcttcgttttattgatgtcaggttcttaatttactaaaactttggttcaatgttgatttttatcatagaattttagtaattgatttaagttataaaactgaattcacacccatgtcagcatacaatggtaagtttcaagcatcattatttaaaatgtgtcaccagttcttgttttaacagataaaaattgataggtattcctatatgttctgctgcttctacattttaaaaactgccagtacagtatgacattaagagcctagaagagtgacttcctggaaaagaacaaaacataattggaaaccagaaactataaaggataaatctaagatctagaaagcatttctaatcttgagaagaaaaactgagaacctaatacccatagagtccattggaaagccatttattctaagtatttactcattcatcaaatatttggtacctcttgaggaacttctactctaatgaggaaacagacaactaaaaacagtgggatgagtactgtggttgaggtacacagaggttgtggtgtgatggaggtatatatactgagattgtaggagcacatgccatagtgatattcaaaatattaatctttacagtgtgggaaacagtgagagtggacacaggctacaaacaacaggcatgactgtctcagtgcacacaagctgaatatcaaccctgaacgtgggaagggtcacctattttgtgctgggaactggagtcaaggaagacttcctagaggagaggagataatggctgagctgaaacctacatgagaaatgagggagaactagataataggggggcggttggggttttaccaacaaagggcactgcacagagcctcttctttgttggtttgcgggaagggtagtgggagccatagcagaccagttgctctctctaaagaacttcctccttaactctccccatcagtccttttataccttccatgtggaagaagggtttaagagttgtatgcttctgtatctcctctgaatttatttatggcactctgtttcataacttaattgggtgtttgataactgtcactttagggtttcaaccaaaaccttgactttatcatcttgttatacatttttcaaaatgaggttagagatcaggggaatgaataggagagaagtacatatttcagttcactgggcataggtgaatagaggaaggagaaaaatgaacatacccaatccacagagaaatggctcacagagcccagtgactatgctgagacgctattaattcaagaaagttttagtatttgatttgtcaaatgacattattgtttaggacttttattttcccttacagatgttgatcttgtctcagaatattgcccaactggaggcccaggtggaaaaggttacaaaggaaaagatttcagctattaatcaactggaggaaattcaaagccagctggcttctcgggaaatggatgtcacaaaggtacagaaagagattttagtgtaatcgttacttaaggaaatatttcctttgaaaaatgttttcctaatgtacaaaactcttactgttatcaggaggaagtttggagtagaaaagttttgtgatttcaagaataataaaaggccacctaatggttactcagcaaacattcagttactacatgcagcccctcagtgggtattgcatgtgcaaggatgaattagacaccagtcatggccttgaagagcttaagggttaagtggcagagacagacttacaaataaataagagttatattactttaattattgaatatttgataaacctcatttttctaaattaattaagagtgctttgtttttgccgtagatagcataaggttggtgtttacaataattgccaaagacatatattgacaacttaaaaggtgtgcttgacataaaaaatcttccacttccttttccttttcagacttggtcattaaaataaagattctaatactacatgatcttattggtgcttaaatttatactttaaaatactacattgtctgtgctatgggcatcactggttcgtgaatcaagaactaaaatgtttaatggtctttactggcaatgattaagatacatattgtaagaaatactagaagtccatctagatttcaatagttaattgctttaaaactaagaaactaataaaatcaatttattttttaccactaaaaacacagataatttgcttaaaatactctttgcatattaccttttattcttcaatggattttcctaaattttgacatatttgtaatgccattgttgctctataattcagtaattaaaattaattttaacatgtattaggaaagggagccattttaccctttttcttgagtttctataattctccatttgcttttaaaaattcctattagctaatgtagaagtttaagaagctcaaatttttgtgtggagatagggtggaagtgaaggaattagttcagaaggatgggaatacttaacctagatttataggtgaaagctatgataagacagttttcagttgataatagagaggcagctttctgttgaaatcagtacagcagagagagagttctctgtctcaagaactagctgaaaggacatatacatcagaagagcgattagactaaatcgccttgaagttgcttccaacgtggagataacatagttctggttcaatttaatgtgttaatttatttgaaatagaatttgagtgctgtggataaacatagcaaatgctgaactgaaagtagtaaagcagggaactgtaggagtgaaatgaagggataaaataattttaaataagacctgctgcttaaacagtttttacataaccagcttgtattggtgttgggttttaaacatcatggttgtataattattatcttctgatgttatcagttcggggttttattccattttattcatagacataaatattaatagtgaacaattgagaaagaaaataaagtatggctcctcatttttttcctgtcactctgaatttgtaatttttatttaggtttaaaattaatagtttttataaatttataatttttgaaatcggaggaataaactctctcacattgaaggcatttgaacttccaatagaatttttaataacttcattattgttctagctttctgagggctactagggagaagcctgttgactttttcttctgtcttgtcactatagcttttaaacatagattaatttatttttaaaattacttttaaggttctgttttgtttgtttggagacaggatcttgttgtattgtgcaggctggagtgcagtagctattcacagacactaccacagtacactgcagtcctgagctcctgggctgaagccatccttctgcctcagcctccagaggaactgggactacaggcatgcgctaccatacccagcttaaatgcatataggttttataccttagtctattctaatacctcagtaatgatgaaactgatttctaaagtttccaaaatcattatttttggagaaataccaaatacttgaaaagttccaagaaagcataacggtgagataatatattaagagccatatatttgtaaattagaagccaacttagctgacttgtacattaattgaactttctataggttctcagttctctcaaaaggcccataatttgcttgtttagatttatctgctaattacacttttcaaatatatttccatttctgtagcagtcctagattcgaaaaaataaataaaacaaagttcttagtgttaagtatagaggatgatacacaacacttttaagatactatgtgtgttcattattggtgccgtattacaattatttcatttaaatgcatattttccttttatattgaatgttacagtcataagtgcatagtgtgcttagttccagtctatggcttttgccagaaaatcttccttaacttgaatacctcatattgtgtatgataagatgacatctgcaaaccttgcagtcaatactggatattacagacctagatatcaatagtatatctatcagcagacaaaaattcctttatacatttccttttaaagagcataactgatgaagtctttaaaagaaaactttgtaatatagagtgaatatttaactgtatcaatgtgaatgaataataacatagcttaacattttaactactaactttacctatttaaaggttagatgatagtgcattttggttgataatatgcaattgaaactgttatataaaataatcttgggcacattacttaaattccttagttatgcatttatttatctgtaatttcaagttgttagaatcaataatccctggtgttgcttctgaatcttaacaagctacgttgaatagtctaatagaaaatggcattcttagaaaagttttgttgtattttatctatatgacctctagggggcaccaaaagatctaattgcaggcattgcctggtagattccagcaggtaatcatccagttttttacaatctaacaggtgtgtggagaaatgcgctatcagctgaataaaaccaacatggagaaggatgaggcagaaaaggagcacagagagttcagagcaaaaactaacagggatcttgaaattaaagatcaggtaagagaggacacagcataattgcagcaattatagatatgagtaacattctttctcaagttgatgttgttttattcctaatttatttatttgtattgtttctaactaatgggatgatccagtttacactgttaggaaaatttcttttatagttgcctaaaattatcacctttcacatgaatggtgagaatacaacagcatgcatataaaattccaatctgacaggtcataaatatacatttggatatgtgtatctattacttacaaaagtaaaaagaaatgttctaatgcacagtttgaacctaaaatatacatacataaagttcttgaaagatgccaacttgaatccaattttaaatgaaaaagtttaaaattcgtaagatgagatgagttgatatgtaaatatgtcaatcaaattgattgttggcagagtgaaaccagttttaactaagataaccatgaatacgtttgttcatgaagcctaaatacagtgacattagaaatgttagtggataaaagctgcgtactttaatttcagtttgaacagatgttttatgttatatctttattgagatgaagtagataactccaattttagttgacaacatggataaagtttttagagaggcagttctaataggctgacttttgattttctatttttatgttacagtacaggaccttgaaggttttcattctttgtattcaatgaaagcaggttgtttattcaattaaaatagtaagactgggttcttagtgtcaatattttaaaataattgttttagaatttagaagtaggtcgctccaaataagttttttttcaaatatgtttctagttcgaggtttttcatcatattttccaacatattttctcttttgagccaatgaagtctttacaacaaatgatgcaaagacaattgggaaaagtattgaaaatgaaagtgataatgaagactagaacaaaaagcttttcaagtcataactgaaatccttagtactaaattaaaatcctggcaaccaaagtaaaattctgcttttgtaccactatatttggtgttgtaatgggttttacattttcagaagacttttaattattaacatgtacaaataatgaaacattttattgcatccagttgggggcgtgcctgatagtggaatggaaaatgctttctgtcagggactgaaggcctaggtctactaagtttatcacagataacttttctttcctgatatattgtaattttttaaaaaggaatcaatatattggcatacttttggcctttcgtattattctacagcattctgacagcataatattttggactaactgcaaaaatacatcaggaaagagtctcagttatttaaaattccattataattttctagaggaaaaaagatcagggacaataggagtataatatcacttgtaaaggaataacttgtttagaagcatttgcaatattagaagtatttgcagtattaaatctcattttaattaatccgtgatggtatggaggctaaagttgcaggatttacaaggagcagttttcatttgtaaacgttttctgataatagtgaaacaatagtagttttcataatgacgtttagtggtatgtttttagatagagatgtgcctttttaggaggtcacagctttaggaataaaacctctgaacagttacaagatgtttgtgatgtgttgtgaagtgatgtgcttgttaccatttttttttcccagacggaatgtgaggaaatcttataggtactctttttaactgttttgtattgaacagacagtttcagaaaagaagtcgtggtgtctcattccatggatgatttggagtagcaaagcagcaattgttctttggtctttcagccatgacctgaccttctgtctgtgagaccaaagaactactttgcttggccaccatctgcactcaagagagaaatttacatttaacttttaaaagcggggcatgttgagcatttatctgaaatacctacaataatataaagtagattaaatgtttaagtgttgtgtatcttacaattcagcatcacaagcaggctatctgtaggtttgcaaacaaggtgttcttcataatatagtcattttattcatattttagttcatctgaccacttgatacatttttaaagtgggtgggaaactgtgagattggaatgtgtgagaacaacagcttttttgatgtatacaaaatagggcaaatggttaaccaccaaaataattttccttgtgacctgagccttggctctggcataattagaaggaaaggttaggagagtaacaatggcagtcgcttccacccactttcttcttttcttctttatattgtgtcaggaaccgatgggcggattatccttcccatcaactcctttgtatctcttcagcttagagaattcctgtcagcctcagaggatgcttcttgcaccagaaaaagaggcatttggtatggaggagaatgtgaaatatgctctttgatttttatgagaaatttttttaggcaatggttatacacacacacacactcgatcaggggaatttaaaaacatgtatgagggtatagggaatattgtaatgagtcctcacatttccatcacctacactcatcattttgcccgtcctcttcctcagtcctattccatcactcatcattttgccagtccccttcctcaatcctattccatcactcatcattttgccagtcctcctcctcaatcctattccatctatctcacttttttctctctacttctgtcctcatcgtcaccttcatcttctttgtcatgttttttctgctccaccttctcatcttcatcttcttctgtcttcttcctctacctctttttcttcttttgcagaagtattttaaatggatctcagaccttatgttattttactcataaatacccatgtggatctatgaaggatatttttacatactatgtcattatcatacctaacaatgttaacaatacttctttaatatcaaataacacccagcctatattcacatttctttgtctcaaaaatgttgattttacagttggtttattcaaattaggagaacaagtatgtttttgtatgtccaattttctggtgttaccctttttaataggaaataaacagaactcttagtaaaatttcatctttctttgttgttgtctgttaaattttgtacataatgttttgattatgctttatttttataaaatgcctcattgtcattctaaagaggtataaattaatcctacagcaaagtatgtgaaggaaatggctaccacgcagcattcctgataatcatatcccaaaaggagcttcctcgcatccgaaaccccaaattcagcattaatttcacagccttgtatttaagatttggacatgttgcaggaggccctaacatgacaaggatgagctgacctgaaatgagtgatgcagaaatagagtttttttgtcaacttcccttttggtaaattaatctgagaagacgattctttatagccgctaacctttgattagggcccagtgcaaagtgaaaatacaggacccttttgttcagaaagcaggaaagaagtgatattaaaaagaactaaaatataaaacattttcctttcttcttcagtctctctctccttgcccctcctccctcaccaacccaggctggacatgcattttttttttttttcttttttttttttttttaggacggagtctccctctgtcgcccaggctggagtgcagtggcgcgatctcggctcactgcaagctccgcctcccgggttcatgccattctcccgcctcagcctcccgagtagctgggaccacaggcgcccacgaccacgcccggctaatttttttttttttttttttttgtatttttagtagagacggggtttcgccgtgttagccaggatggtctcgatctcctgacctcttgatccgccggcctcggcctcccaaagtgctgggattacaggcatgagccaccgcgcccggcctggggcgggaattcttacctccctgtccagctctaagatggcagggatgggcacacttgactcaatcctctctaaacacacattcaggattctgccaggggcaaaagacacaggagaacacacacctcccccagtgacatacgcacctcccccagtgccctggtcccaccctaggtggagggacccaccccagcagcagggcagggcgggatagaggaagctggagaggagtatatttctgagaactgcgtagggctgcagtgaggcagtggaaagatgagaccacatacaggagttcagtctccattgttccatcagagtacacctacaaaacacaattctagccgggcgtggtggctcacgcctgtaatcccagcgctttgggaggccgaggtggcggatcacctgaggtcgggagtttgagaccagcctgaccaatatggagaaaccccgtctctactaaaaatacaaaaaaaaaaaaaaaaaattagccggacatgatggcacatgcctgtaatcccagctactcaggagggtgaggcaggagaattgcttgaacccaggaggcggacgttgtggtgagccgagatcacgccactgcactccagcctgggcaacaagagcgaaaccctgtcttggataaaaacaaaacaaacaaaacaaaaaaaaaaaaacacaattctaagatacaattgctaataatttcaagacattgaccacagagtattaaactgcaagtgtaaggacccttctgaacagcacatgtgtgactgcactgatcacgtgcccaagaaactgccataaccagggggatgggcaaatggagattttgcatactaatatatgtgtatatatccccactcacatatacagacacatatgcatattcaatatgctaatgtgcccagtattcataaaaaagtgttagccaactacagctcataggtcaagtctggcctgctgtctatgttacaaataaagttttattagaactcagccatacctactcatatatgtatcacctattgctacttcctgcaacaacagcagagttgaggagttgtggtagagaccatatagcccacaaagcctaaaatatttactgtctgaccctttacagaaaaagttgccaatccctaccttgagtatagaaatacaactgtattttttaagtttcctctgacttactaggatgctgagctttgagtttgaagacccatgtatcttaaataataacaatggttttagagtattttgcagtataacaaatgtgccacatctttagtctcttaaaaatctaatggcattactcagcgagtgtatcactgataatcatggcattttcttattagtggcacatgacttactagtggcttggatgggagtgtaaataccgtatgattttatatttacaattttgtttttaggttggttccaattttatttttcagagataagaaggctgatatagaaagcgtctttctttttttttttttaccggcattgtataaattataattttggagttgtggctactactgagtagaaaacatcaagtttgaaatgactttaatggagcaatcaaagcaaatattcagggtggggtatctctgcaaaagaaatagatccaaaaattttggctggaaaaatgagggcaaaaaaggatttgagggttgctcatatctacagcagtgattcagcacttggacactgacattaaggatggagtgtaaggacacaggaattatcgcctaaattcagttgaattaactagactgttggaagaagtgcatctatattgtatggctttgtgtaaggagaagaaggcctgcctgcaagccctaaaagtcagtccttttttctttctttttttttttgagacggagtctcatactgtcgcccaggctggagtgcagtggtgcaatctcggttcactgcaacctctgcctcccaggttctagcaattctcctgcctcagcctcccaagtagctgggactatgggagcacgccaccacccccagctattttgttgttgttgttgttttttagtagggacagggttttaccgtgttgcccaggctggtcttgaactcctgagctcaggcaatccacctgcctcggcctcccaaagtgctgggattacagacgtgagccactgcgcccggcctatgtcagtcctttttaaagttagagaaatataaaagcaataaagaaaagttgaagaattgtaccttttacttagagaagacttcaacattgcttcacatcttcaaggatttgacaaattatttcaaggaaaaagttaaacacctgatttgagtcttcaatatggacagaacaagaacaaagggatttaactacagcaactacaaatcacaatagcctgaaacaagaattttctgacagtaaggagattgaaattgctgcaacaggccatggaaccttttccctggaagttttagttttaaatagtagcagcaatatgatttacctgaagacccagctcatggacctctgaggtccagtcttctatttgattctggaagcgtcctagaaagacatcgttgtatcttttaaaagtgggtaacagcagtgttagtcttttctacttgaaacctagcacttacagattaaagtaaaatcctgttccgttctattctctgctttgtgtctttaaagctgtgtactctttttcagaaggtttttggggaatatgctaagataatggatgacttctcaagagccagacttcagaaacttatccaactaccacctgcagtctcacttctccctctacaaaatgactgggagaggggccatttgggcctgcctttggtacatgtaatcactcggtcctggtgatgacagagttgctctccagtattcttcacaccctctttcagtctgtagacttagcacattcttgtccctgctccctacgaagacaacagcagttccagagggcttggcttacccagaccagtatgctagacactgtgggggtaataactaggagacccaggtcctacccttagggagtttatattctagttgaggagtcagagtacacattagaacatgccttaagaatacttgcaaagcagcatatcgacaagtgcaaattaatgtagtgtgaacttcatgctggctacagcccatgagagggagaatctggttccatgtgtgtgatgcaataaagcttttttatagcatcttctctaagtatgccctaaagcattgttcagcatacttagagaaatttgtgttcttatcgcagcctaaccaagaattctgagaaaattcttcagcctaacatatgtctaataaatcagcctcttttgttcttgtcctggatgatgcttgaatgggacaagtaggatttattggattatacaaataatttaaaatatgttcatttaataaaagtctaagttattgattgaacttatttttctaaaatgctgtgccaaattactttcttcatctaaaatcatcatgttggtaaaatcacaaaattagcagtaaaaaaatataattcaatttttctgcataaagaagcagttccaaatcaatccagtgaataataccgagttggagatcattggggcatttagcatttagtcacgttgttaatgatttaggcagttgttttctgaggcagggtatgtatacctcattcatagaaacactgacttttcaattaacatgctcaaaaaaagaatctattaatttctgcttgttatttgattttccaacaaagatgataatgctgtttaacataataatttattttacaaaatcaaatgtataagcagagacaacacatctgaaaatagcaatttaggtatatttagaagataagagtacaaataggaaataaaacaagctttcttagaaataatatgccttataggagaaacattaagaaataaatatttgcctttggatgggaatagaaaactgtaaactggactctaagaatattcctgtgtgccctgaagaaatataatgtttgctatattttcagtttcagtggatgacatgtgttttggttctttgaacatttttttgcatgcttgttttgactgtaaaagttgacttaccagccaactgccaacttgcaaagtgccttctcaggtaccaactctgcagttctggtagctaccaggtagtgacagttctttaaatgtgtccatgcagcccaacaagctgagagacattagacataagacaactacatatgctttctttttgtttatagtccagaaatattagtacctatatccaatataaatatcactaattactacatatgcatacatttaaaaaaatttattgtataaacataagcacattaacagaagccagtagttccatcacccaaacagtgtaaattgtttttatttttctgttttaccttccactttttgtacatatgcatctataatatttgcaaatataaatagattctagttttggtttttgcttttttcatttaacattatcttaagcattttttctgtgttgctccttattcttcatagtgatcactttactgtggccatttacatatacctgtaagggaaaatgatagtaagttagattttgagaacagccactatgacagatttagagcccttttgccctaaacttcatatgttgctttaattcaataaccatatattatgtgcactctacttagctataatcaatttctgtcagaaaggagtatgtaaaccaggtatgccaataaatatatgtcaaagagaacatagtagctatcagcaaaatgcaaaaggcatgggaatttgggaggggaaagataacatccttgcagggtggttagaatgttgcctagggccagccgtggtggctcatgcctgtaatcccagcactttaagaggctgaggcaagcagatcacttgaggtcaggagttcgaggccagcctggccaacgtggtaaaaccgtgcatctactaaaaattcaaaaattagccgggtgtggtggcgcgcgcctgtaatcccagctactcgggagactgaggcaggagaattgcttgaacccaggaagcggaggttgcagtgagctgggattgtgccactgcactccagcctgggcagcagagcaagattccatctcaaaaaaaaaaaaaaaaaaaaaaaaaaaaaaaaagaatgttgcccagcacggatagaagaagaaatttatttggttagaaggttcaacatggcagcttgagcaaaggaatgggggtgaaaaaggagggtgcatccaagaacatatgtgtcttttggttccatagcatttttgtataactgacctccattatttcaagtgccacttctctgttgtaatagattgctcatagaaaatgggttttagtaacactcagaatcccaatataattgtctccttgtaatatactgtatgccctgcagtcaggcacagaagtcatggtatcgtttgggaatgtatgcatatgtatttcatttgctttgtagtaggttttatgtaatggaaaaattttaagatttttcaaatttcagataacataaataaaatgtcattttatttacagtgttagagtcatataggattgttttcctagaaataaagaattgacaattatcttgatttgtggaggattagcacatgactgttgatgaaaggtgaaacacagatcatacagggtactactttacttaaggaccatgagtacaaagtcatgactttctgatttagcttttccagctaatttcctgagcaaacctctcagagcctcagtttatttcccagtgaagtgagaagcttggacaagtggtagcaaaagttttctccagctgtaaattcttgcatttctagaaacacaggaagtatttctttgcccctcttaattgtgaattaaatattcataaaatcaacagaaattgcatggagcctcaagttttattctgtattttccagttattcactttcactttataaacatgacacttttgttaagattataaaaatgaattttgactgtcatctgcaattttagacattttcgttatgattggtaatagaacaataaaatgtctagccttgtaaagagttaagtttacttacaagacagacatcatctaatttgcaacaaggattaaagccccactctgaattaaaatttctactggaaagatttgaggcactggcaaactgtcaaaggtagtattgtgcgagagtaaccagcttttgcaagacctgtgaaagtaaatctcttcggccagagtttcttaggtgtgtgaacttatgatgatcaggaatacattggtggattcccactagagaaacgcaccattaatagttaatgctttcactttctgttttcacttgttgccctcataaatgcaagcatggaatgaaaagctgtggtagttctggacacagatgacctagaatatgatcatcttaagattttgctctgggagttctttttaaaatcaatcaaaatgaaaccaaaaacaattttgcaattgtcttagaggttttacagatccctggcatgtttttctgaccctcactggagttcagtatgagacagaccacgctacaaagagattcctgatctaactctaggctgttcatgagtgttagacacacagtgtgagacagatcaccctacacagagattcctgatctaactctaggctgctcctgagtgttaatgagttgcaaggtgtttagagttttcatattactcttcttaacagatggtcaagttaatttaactctttttggtgttaacatctgtacttaagtggatttgttacacttacatttaggaaaaagacaagaaagctgcagggtctttatttctggcctgccttctgccatccctgaaaatttctggagtttcctataggaatggaaaattcttctttgtataaaatctctctacttacaactgaagtcctgataccttctctctctctctctctctctctctctctgtcccctaccctctctccatggtaataaattatacaagtagtagtattagcctttcttcatgagtcaagctgtcattgaaaattcccattaaagtgcgaggggacgctcatatctttaaagaaagtgtggctgccaaggaaacgagggaggtaaaaataaacttttaaggagatcttgagatggaagagaaagaatcgttctactcgaaagattatttcaaatgctaccttttctgttggactcttctttctttctttatgattaatattattattttgggatttggtgttttactctgttgtccaggctggagtgcggtggcacaatctcggcttattgcagccttgacctcctgggttcaagtgatcatcccgcctccacctcccaagtagctgggaccacaggtgcatgccaccacacccggctaattctttttgtatttttttgtagagtcagggtcttgctatgttgcccaggctggttttgaactcctgagctcaagccatccctccacctctgccttcccaagtgctgggactacaggcctgggccaccgcacctggtgtggattcttctttagcttgcttagaatgttctgcaaagaaatctgaattcactcatatggagaggtgattgtcatatcctagtttgcattagaaactttagggtgtcattttcaactaaatttatcgtagaactgtaggagggtcagtgtttcttccctaatatactgaaggtccactatgtgtatagcaaattaagctatgcaaggttttatataataagaaccagacatgtttcattttaaaggcggcgtcaacacagactaacgaatacatcaaatatctgtatgtatttttaaatctatatgtagatatatagctttctatatatcttattaatctataaccttactgtgacttactaatgatttttcttgagcagaacctgaagtttgaagtatctcaatgctgaatttgacataccatagacttacttcaatggctaggagagcaagaaagatgctagaattatctttagttataaaaacaagaagagaaaagaaaagtagtggcgggggggtggtgggggaagtgggaagagaaaatgggaaagactttagaggaagacattctaaaggcatttatactaagaagaattgggctttttttttcctgtttatactgtttcaccttaaactataactcagaagaggcaaacatgaccacctatccatcagtataataatgcatcaggattttcagaagggaaccacaataatggattttaaaaaaccattactggtatgaaaatcccttttcccctacaaccactgctgattgtcgaaaataacttcatgctagacatggtggcttactcccgtaatcttagcacttcaggtgtcccaaagcaggagaatcgttgagcccaggagtttgagaccagcctagccaacatggtgtgaccccatctctacaaaaaaaagaaaaaaaaaatcaaaaaattacccaggtatggtgtcatgtgcctgtagttccagctacatgggaggctgaggtgggaggatcactcacacccagaaggtcaaggctgcaataaattgtgttcatgcactgcactgcagcctgggcaacagagcaagaccctgtctgaaaagtaataataatatataataataactttatgtactttggcatttttcagaagatgcttcttacccacatagcaatggaatttatgaaggtaacttttgggccgggtgtggtggcttatgcctgtaatcccggcgctttgagaggccgaggtgggtggatcatgagatctggagatcgagaccatcctgactaatacggtgaaatcccatctctactaaaaatacacaaaattagccaggcgtggtggcacatgcctgtattcccagctacctgggaggctgaggcaagagaatcgcttgaacctgggagacggaggttgcagtgagctgagatcgtgccactgcactccagcctgggcaacagagcgagactctgtctcaaaaaaccaagaaaaaaaaaaagaaggtaacttttgtctttagtctttcctatttcaatggccacatataaaggatggaaggaaaggcttcagataataaagagcaatggcttggtgggcaccaagggtcagaaagactttaataacttagtccacctcctccattctgtatatgatgagactgtgagtcagctgggagtaattaccttatttccatgcagccatttatttaactaataattagtgataacctattatgtgttgcaaacaaatacgcacaggggtgcaatgaaaaataaaaatatatttactgctcttaacaactcttatagtttggtgaggaagttaaatgtgctgggggctcagcaaagggtgtggcctactgtggcgggagagggtccagaaagattttacacatttacagtcaattgattttcagcaaggatattaaaactcaatagggagcaaacagactttacagtaaatggtgctgggaaaacctgatacccacaggtaaaagaaagaacttgggttcctacctcatagtgtagacaaaaattaactcaaaatggatgaaagactaaatgtaagagctaaacttagaaaactcttagaagaaaacataggcatacatcttagtgactttggattaggtaatggtttcttaggtatgatgccaaaagcacaaagaacaatagaaaaaaaatagataaattgaatgtcatcaaaattaaaaacttttgacctttaaagaacattatcaagaaaaaagacaacccacagaacgggagaaaatttttggtaactcatgtatctgataagagacttgtatctaggatatgtaaggtacatttacaatttaataataaaaagactcctcaatttttaaatgggcaaaagatccgaatagactttttttaaagaagatatgttaataataactatattattaacaaatgattaataaacatgtgaaaagatgctcaacatcattagctatcaggaaaatgcaaaccaaaaccaagatgagaaaccatttcacatctactttggataagtgtaataaaaaagacagataataacaagtgtcggtgaggatgtagagaaactggaactcccccataagttgctggtagaatttaaagtcatacaggctgaaaaatattcgggcagtttctcaaaatgttcaacatagagatatcatatgacccagcaattccagtcctgggtctatactcaagagaaatcaaaacatgctactcaaaaacttctacacggatgttcatagcattattcatagtagccccaaactgccaataccccaaatgtctatcaactgatgaatggataaataaaatgtggggtgtgtgtatatagatacatattacatggcagtaaaaaagaatgaagtaatgatacattctacagcatggtagacttacaattgaaaacatcatgttagatgaaagaagccagtcacaaaagacaacatattgtatgattcaatttatatgaaatgtttagaatgggcaaatctatagagacagaaagattagtgattgtccaggtctgaaattggggacaaatgggagggactcctgatgggcatggagtttcttttggggtgataaaatgttctaaaatcggttgtggtaatagttgcacaactattttatttcctcagtcctgaacttcatgtccaggtagagatttattccctagagtaactaaggaggaggagtgttagccagcaccttcctccttcctcttggtgactagagtgttagcacgtcagtccaattctgaagttcaatcattggaagcctacttacccatagatttgagccacattctctaaaattgatttcattgctaatacagatgaacaggcttgctccatactgttctacaggctgtgcactgcacaattccacagatgccatttgcactatagtcatggcggcctcacagtgaatgtactaaactccgtgaatgtactaaaaactattcaattgtatactttcggtgggtgaattctatggtgtgtggatgatcttaataaagttgttattttagaaaaaaaatatatcatccaagtcatattttagcccagtctggagggaacaagagtgggaagtgaaggccattcaggaaaacaggacagagtcacaaaggcactgttctgtgtgtacctggagggcacaagcgggtgcaacagatgaggaaggaaagacagagccccacaaaactgaaatgacatgccagaagtggctgtaaggtccttaaagtcagggtcttaacttacccttcattgtgtgtccggtactcggcacagaggagacctacggcagatatttatctgttgattgagtgaatgcatagtgagctaagaacaaaccttgaatacttagtgatagtatctaaatgagatgactgagcttctcactcctaggtcagtctttgttgtgctatgtctgatggaaagttttagaatcaagatgagaataactccttttataatgatactcatattttagcagttatatgtgttgaaaatgtttgatcagtcttttttatatttagttgttctagtaagtatataatggtatctcattgtggttttaattttcatttccctagtgatgaatggtactgagcattttttcagatgcttttcttctgtccatatatcttcttcacatatatccactgctaccgtctagttcaaggtactgtcgtcttcagctgtgttattgcaacagtctctttttttttttttttttttgagatggtgtctcgctctgtcacctaggctggagtgcagtggcgcgatctcagctcactgcaaactctgcctcctgggttcacgccattctcctgcctcagcctccctagtatctgggactacaggcacccgccactatgcctggctaatttttttttatttgtatttttagtagagatggggtttcaccgtgttagccaggatagtctcgatctcttgagcttgtgatctgcccacttcggcctcccaaaatgctgggattacaggcgtgagcccccatgcctggccagcaacagtctcttaactggggctccctgcttctcctcatctagccccttcacagcataagggccagagaaagtctgttaaactttcatcagccaggtgaggtagctcactcctgtaatcccagcactttgggaggccgaggcaggtgaatcaggaggtcaggagttcaagaccagcctggctaaaatggtgaaaccctgtctctactaaaaatataaaaattagccaggcacggtggcaggtgcctatagtcccagctactcgggaggctgaggcaggagaatcgtttgaacccgggtggtggaggttgcggtgagccgggattgcgccactgcactccagcctgggcaatagagtgagactccatctcaaaacaaaacaaaacaaaacaaaaaaacaaacaaaaaacaacctatgtctgatcttgtcacccttctgaaaccatccagtggttcctacctcagtagcagtcaaaggcaaagtcaaacagtgaccccctcatggcacgcatctgctgacctacaactgggcagtgaatatagacatttgcatttacctgtctggaacttggtcattttcgtttgggcctgttgtgtcagcttgtccgagctctcttggatcctcttttcaacatattgccataataaattattcctctcaggtttatgtcactggttagcaaggtgctaaccagtctgcccccacgaccacttcagagcctttggacttgctcttttcttcgccgggttctctgggatatcctgtggatcacaaaataacccttcaagtcatcgctgaaatcatctgtgtgagactttcctgactaccttgttttatgttgtaaaccagtttccgagtactcctgccccctttctgctttattttactccatatcttactcatttgtttattatcatctttccttatcacaaccttagcttcataaagttatgccctctttattcatactcaacacatttgcgaaagcaaaacgtgaattgcattgcattgcattgctcttccatttagcaatttggaatggcttcccatttgcatttagaaacatgagtccaaactcctttctacagtttataaggccctgcataatctccccactgcctgtctttccaccctcttctcatccacccttcccctgtccattcagtggagcctccgtggtttgcctttagcttctcagacatgccatggcctttggacaaacatcttccacatatattctttcccactcttcctttgcttaaccagctctttttctttcttttggtttccaattcaatgtctctacttcactggctactaatgtatactctgttattctctcacagcacctcattcccctccttcatggagcttattataagttttttattattttattgttcatttgcttttaaacaatcagtttcttccattaaaatgtaggttgtttgaggacagagacttttacttgtcttattctcttttgtattcagtgccccagtgccctgattgcaattagggtcacagtaactggatggataggtgggtgaagagatggccaagtgactgcctcaagtaacacagtaactggatggataggtgggtgaagagatggccaagtgactgcctcaagtaacacagtaactggatggataggtgggtgaagagatggccaagtgactgcctcaagtaacacagtaactggatggataggtgggtcaagagatggccaagtgactgcctcaagtaacacagtaactggatggataggtgggtcaagagatggccagttgactgcctcaagtaacacagtaactggatggataggtgggtgaagagacggccaagtgactgcctcaagtaacacagtaactggatggataggtgggtcaagagatggccaagtgactgcctcaagtaacacagtaactggatggataggtaggtgaagagatggccaagtgactgcctcaagtaaatttctcattttactacccactacccaatgaatctgaacaagttactgaaaatgtgcaagcttcagttttcctctttgtaaaatgaggatagatacaatgcctaccttataggattttgtaaaattttaggtcatctatgttaacctcatagtacaatgcatgacatgtaataattgctcaatacacactaataattactagttttactaatactgtgatccttagcttttccaccttcatctctctcccatctgtgtcccattttatcacattgctttccagagtcgtgatgattactgaatatgagactgctagtttgaactgcccagtgcatagcagtggagctattgcctaagcttatgttaatctagcatcagagccaactatcatttgccttattgtttatcaaatatgtctcattgtaaattcttattgagcttaaaattcaattaaaacccctcatggcacgcatctgctgacctacaactgggtggtgaatatagacatttgcatttacctgtctggaacttggtcattttcgtttgggcctgtcgtgtcagcttgtccgagctctcttggatcctcttttcaacatattgccataataaattcttcctctgaggtttgtgtcacagacacatttgatcagcacatcggtggcatcctcattaaagtcagtggtctaaatagtatagcacagagagcatcacagagcctatgacctgcagcttccttgtaatttgatatttgctgttctgtcttccatgtgatttgttctaattgatgtttaagaaccagatcatgtttatttttctgtttaagaaccagaccattgccttcttcaaaataattctagtcaaataaaaaaattatttttatgcctactgtgtgtaagtagcttgcctagataccgatgaaccatgtgacagaagcttgccttgatggtgggcaatgaggaaatcgggcatggatggctaagaaatcaaagtgccgttgtaaatatggagcagatttgtagtttggcaggatataaacccgtgttgggaaactcccaatgagaggtcaaaattgaaatggggctgtctgaaattccattttgttcatctagataacctggataaatgggctaaattggaaatttgagtcttaaaatcatttttttgagatttctcctattcattctattgacttactctccattttaaagtcttttgtcctaatcatttaccctatatctctctgttctatgcctattttatttttctttatgaaaatgggtgaaagcaggaattttgctagttttctaattatcacagcatataaattcagtaatgtatgtgaaagtgttttctaaactatgaaaagctgtatacatacataggaatagaatggattgtcaataaattgaagagatgagtttactcctttgtatgtggaagctgttaatttaaaataacacactcaaaatattagctaaaaatctacttcacattttggtgctgcttgctaaaattagttagaaaatataggttatttttgagttaaaaccaagttcaataaattcttaagttcctcaaatagaattttacagaaatatttacataacccacagctaaagtgagttttctaagaactccccataaggtgagatcacgtacaccatgtctcagtacagaaggatttttttttcaatcagttatgtctctataaataaacctagttttgttgttaaaattgctgtttcctcttcacataagaacatgtcattaattttggtgaaaaccttccaacaaaataaggttaaattgtccagttttccagtggaagaggaattattttgtgtcaccaacaagcagagtaacagcttaaaggtaagttgaacacagacatgctgtttgggtggtcagaatattttgcatccaagcataaatgttagtaagagcctataggtgagaatgctttaggtatgtttttagtaatgctttacctctgctactctccttaggatttgggaaccagagcattcatactgatgttctctgtaattaggtacaccaaggagtaacagaaactgggtaggtaggtaggtagagagaggtgacctcagccagagccggtgtgtttgtataggcaagaagaggagctgtattccatggtctgaactattaagtgatccagactacaagaatatgacttccttttctcagttgtttgaagttcatttagcgaaaaattaaaatacagtttcctataaaacaaaatcatttagtttgaactggaaaaacatttgaggttttcttggtttgagagaaaataaacattttcttttgtcctagcacctataccaaacagtaatattgacaaaaaccaaacctaagaaaatgcattttttttcctctaaattaagaaatagtatgtatggctttaagatgctgcttaaaaaaaaagaataagtcttacatttgttctagttgtcagagattgacagaactaataagagaataaaagagcaaaacgaaaaagttcttgctgattaacagttgtctgaggagaaacagacgatatgttttctttattgcattgaaaagttaattattaccaatagaagcttatttatgcttgtaactgagttagcgttgtggcttggcattattccacatttgaagggaaatgggtatcggcgaagagtctggagcttgagttctagtacagttgagtgggcttagcgagtggtttaacttcactggatcccacgttcccacctgtaaagtgaggcgatagattaagatgatgactgaggtgtcttgtgtccctaactgcatgtttttttcctaaaggcctattttgttttttatgaaacaaaatattttatcttcacagggaagtttactcccaaatgtttttgggaccatttagataggagtacactttagaaaaaaatataagcagcacagtatttaaagaacagaaattgtatttgctaagtaaatactgtacatcgaagtcttggaagttagatacaaaataagccaaaagtttcattttatattccctttagcaatcagaatatttgattattttctagacagtttctgtaagagtaccatttggtataagagttttaatttgtgatagtagaaaagtaataaaaatgtgtacaccatctaagagacaaaataattttgccaaaaattgccttttgttctggttaagaataaatgggccaatttcttttacacaataatttttagtagcagataccatatctaaaaaactatatttactatggcaatagtagcagactaattatccagctttctttggaaattgtgacttttgtagttgtcaatacttttatatctacactgaaaaatttttggctttgaagagtatgcctgcatgtatgttgattttcctgtaattttagtatctgggaaaatattccatctgaagcatatgtagaagtatagaaaattgttgaaattccattttgaaatgacctttaggctgctcttcatttaaggtaatagtgtcaattttgaacaaactgtttcaaaaactttatttaatttaggattatgaatggcatccttgttggtttttaagtatttttaacctcatgatgagaatctgagagcattgtaaatacatttaataatgaaaaagatattttctaaacttgaagtcaataataaacttcttgtatttaaattgacttatgaagttttcttaaggcaaaatcagttataactttatgaatagcaatattttcagttcatttaaatttattttatttttatagatagtgaaagcatctgtatcttatttgaaagtgcctgtcattctcttatttattaaaattgctttagtgtggtttttatatttagtcttggtttttacttgtgtttagccatatttctacacatagggaatggtgcaggagctacaccactgtaattagtagtgggcaatgtgaccaagtttttttaatcttatatttcaatataatttcaatgcaattactctattgagtaattaataactttaatgtttagacataagtgaatataattagcccaaaatataacaacataatgtgaaaatgatgtttagacttcacttactgagtcctgaagccctaatattaatacttataatttcctgctgtaaatttttatgaaaactaaataagagtatcataataatttctgttatttactgtagcccagatgattgtaaatttgaggaggaaatgatgtaccttagatgtgtcattggacttgcacttgttttttatcaaaatgatagggaatcaattaatattttaatagttacaaaagaaagtgaagagtgaaatagcttggatattattcatatatagtgtgtatatgtgtgtgcacatatgtatatgtaggtatatatacatgtatataaaattatctggccatctggatcatatatatatgtataatgtctggcacattgcacatagcaggcacatagtatgtgctcaaaaatatttattgtattgaattgagagcttgggaaggaatagtttaagggaataaattaacagtttgctttcctaaactggaattattttattatattttatttttgcttttggatgatttttctcagttggcaaaaaaaactattgtcaaatggtaataaaagtcaataactgtaatgaatattccttttattatgctgtgatatgttttcctgcattttgggtaactgtttaaagataatttttctttggtaattcttttatctaccagcttttatactttttagatttttcatttttattcgccattggaaagactactttttttatatggagatgtcccaccagaaaagattgttttcctggttttttgcagttcattttgaaagaagcaactccaggtttatttttgatttgaatacagctagtgtagcatgagaaaatccttttgaagtgctttcagaaggattaggtcagggttaggtgtagttttttttttacataaagtaaatttagagttgctattttaaaaaattgtgccaatttgttagcaaacacaggtcaaaggtacctttacactggtgactttcacctcagaaacagtgggtgatcttcaccagtcaccctctttctgcttttctgccaaggaagggatcatggcttggtctcagggaagaaaggaaggagtcccagtttcttcctggtacttttgtttactaatgtactaagggctattttattaaatagcattataagtcaacttgaatatattacatatatttaatatatgcattcatgtataatattaatataatatatatgtatatcttaaaatagatgtatatatctaaatattatatgtaaatatacatgtgtataaaattagtcttatatattaacattttaagtggaaaatgattttttctttcattaaattggaatgtcaagtacatggctgacataatttccttctagaaaataagaacctggctagacacagtggctcatgcctgtaatcccaacactttgggaggtcaaggcaggaggatcgcttgagcccaggagttcaagaccagcctgggcaacatgacaaaaccccgtctctacaaaaaaaatacagaaattagcctggcatggtgacacagacgtgtagtcccagctacttgggagactgaggcatgagaatctcttgagccggggaggttaaggctgaagtgaactgtaatctcaccagcctgggtgacactaagacaatgagaccctgtctcaaaaaaaaaaaaagaagaagaagagaaaagaaaagaagggccaaactgttacttttttgagcctttctttctttagaaatcataacatttgggtggtcatagcatattaaaggattccttttatatgtataccaagcaaaggaatataggtctacattagtctttttagttatgttctctccacaaacattataagaccatcatatttaaatgtcccaatatagcattttatagtatgtgcagtagaatagatgccatagaattaccagctttgcaaaacaaggaactgccaaatatccaaaatgttttgagtttattaccttcgttaacatagctcttgtgatacagctctgaacaaaacatagaaacattctcttggatgatagttcatttaggtgggtttgtaagtcattgagcaccattcctgggatgtctttcctacagatacagtaaacattgtagtcctccagtagtcagatactaaaaacagtcaactcccagctgagtgagggggaagagcggaattaggaagccactttcaaaatctgtacagtgatatcagacccttgatatttgtagggacaaatctacaatcttcacaagtgaaggcaaaaacaatgaatttctcctagtaagtgtagtaaggtataacgggtcccttcaacctctggaatgtttataaacttagaataaaaattatttgtgaagccagtgaaataaatcctactactaagataaactcagtgtatttcatcccagtggagtgacatttcaggagggggttatgttccaagttcagcctaaaaggttgaatattgcatgtgaccaaattactttaaaaaaatctcataaattcctcataatttaatggtctacatggatttgtctgtattgattttatgtgcatttagagccatatattcctgccacattggagacattcataccctatctcaaagattttaacccctatcactttactttcattgttgggatagattgctgttgaatcaaatggggagtcgataaacaagttgacttgtgtttggcaatgtttgtgctttgtatgaaaaatatacgtgtttcttagatgaaattaccacatagtgttgtcagatggtcatactatgaaaggtacacatgtactgtgaccgaccaagggctcagtggagtcatgtctcactcttcatgctcactccaaggcattcactcattgagttgaatggtggatggagtcacccatacttcttccatttatctctttctgttacatgttgcaactctactatatgttcctattgcagtaactatgaaccatctgattttatgatggtaatgtttgaagacaaggatgaaatgtaccacatagcagggtgataagagattgcatctcttgagagccatttacatcaaactcaagagcagaaacaggggaccttaaaagtaagaaatgaaggatacaacctgggcaagagacaggtgtgcttctgaagtggtaggtttttaacattgtgattgatggctgtcttttatagttcagctcttgatacattttctggtattgaaccaatgcaaaacttattgtcagacaattttaaaactccacaccattgacagatgataactggtgtggtcaacaattaggagatttatatatttgactccttcattattttaagacttttctatttatttcaacattgtcttttttcacttcatctctttttactcacaatttcgggttgtctttatccatttcaatctgtaatctgaatctacctctcccagttactcttggcgatattcacattaccctaacaactcttttgcaatgcatcgtttgaaaaatgtttcacctctcttttatagctttccaacaatcacatcttatttcagatttttccctcatccagggctatcttaatgttcctttacaccttttatgtctgctcctagcatcagcagacataaaaagtcaagatctctatctatgtatgcaaatatgtcagcatacaataccttgaacattgttaatattttactcatttagaacactgaaaaagcatgataggattaggggcagaaaaggccctatattattttaaagaaaaaaaattgcagatttaatgaatggcctgatattttgtctatgatgattagaaacttacattcataagagtgcaaagcaattttttttccatttttagcaaacataaagtctttattaaacctgtcccaaaaaagtagagatatcacctgaactcatttttgtaaactgaccgcagagttgtaatgattcttttgccactgaatctcctggcatgacagaacagtggtgtaaacttggcttagtcaaaaagtctgccgtattgtcgcaatgtaatacagtcagctttatatcagatgtctgaaattcttctcttctttagacacatacttttagaaaggcacttctttcttgccatagttccatttcatctgttttgaacacttgttttggctgagagctacgttagctctgaggaagtgcttctgaatttaagtgatcagttgatgccacttctgttaacattatgcaaagaaaaaaaaagtttcttaaaattccttaaagaatatttgcttagagtaaggattgattaaatagccacattggaagcaattggaaaactgaaaagttccacaaaaatgttgcatattttattgggaaggctgaaaggttaagttgcacgttgattcttaggctggcgtggagttcatcatgttgtaaaaggtgtagacagtgggacttgaggctaagcaaatccaaacctcaggacgtcttcaagtcactagccctaaagtctcctgcagaaatgcttcttcagagtgaaccaggcccagggctttgcacattgagatccttgtgtttggtagcatgatacttgacccatgtcatctgggttgtatcttctcctttgtctctgtgctatttgtgtcttccacctatgtcacattataggccaagaggttttagaaggcagactgtgtcatttcctctttattttctcttgtatctaggattgtttagggagacaatatggtgtagtagaaagattataggacttgaaatcagactaactccgttttgaatctcagctctgccactgtataatcttatgtaagttacttaacatctgtgagcttcagttttctcatctgtaaaacaggaataggatacttatttttatatggttgtcatgaacacagaatggaattttaaaatataaaatgctaagacagtgcttggtacatggtaagcactcaaaagtgatagctggtatcagtgttactattaagtccacagtgaaagcatgaagtcagcgttatgtgcaatcaacaatggtaaccgtgaacaggatttctagaatggtatcagcaaccttctgcatctgctacagtgaagaggataatcatttttggctgtttctaaaatgagtttctacttataatatccttttgttcacataggctggttccccaagtgtctagcttggagaatgagtcttagaaataaattttgctatattctagaccagtgctatgccaaaaaattttctgtgatgatgaaaatattttatacctgcactttccaatatggtagccatggaatcaccatgtggataccaagcacttatactgtgattaatgcaagtaaggaactaaattctttattttaattagcttaaatttaaatagccaaagcaagctagtgcagctctagacaaaaatttactaatgatttgacaaaatcaatcttaacatctataagttaataaaagtatgaactagtaaatactaaatttccaatgagttcatattttacacacaccgaactttatagaaatgattattttctcccaagtgatagattatatgtttcaattttcagtattatatactaccttacttttggaaatatattctttgaattcatccattggcttctgagtgataaattcacattgtcaaaatttgtcagcctcaaatccaccagttccttcttttaacttgcgaggatttttggatctagtcttcttactgttctgtaatttttcttctccccattctcatcttctgttacacaaacaagtcaccctatattaaagatggcgaaataatttttaagtcacataatgtttactagcaggaataaatcactaccattgaggtattatagtttatgcttctttttctttccaggcaaatttatccttttgaattaagatgttatataatttttcaaataggttttgcattcatttctttggatattttttcttaggaaatcaggaaaaatgtatagtagagtttcttttaatgaaactttttatttggttctacttaatttatgtaaaaaatatattttaattatctgaaatacagaatgcttctcaaattgtaggattgtgaaatcaattttatagattgaagcaagaaatgtttttttttaagaagtggaattggacaggcatagtggctaatgcctataatcccaacactttgagaggctgaggtgggaggattgcttgaactcaggagttcaagaccagcctgcgccatatagcgagactttgtctctactaacaattaaaaaaaaattatctgggtatggtgacacatgcctgtagtcccagctacttgggaaccatatctatatctatatctatatctatatctatatctatatctatatctatatctatctatatatatatcttaatatatatataagataagataaaataaaagtagaataaaataagatggaataggaaatgtcagagcacatcacacatagtaagagttaatattatttcttgaaatgcttcttacatttatatgtgtgtgtgtctctgaattgtgatttaaaatggattttttactatggatcttggccaaaaaaatgtttgaaagcaactgcataatttattgtacgatgtggtgaaggcagtgaagtcagaagatctggttcaaggcttgagtgtactgctttagacaattttcaatgtcttcaacccaaaatttcttatatgtgtaaacagagatacctgccctatatgtttcatgcagttgtttcaaatatcaaatagaattctaaggtgatgtatagttgtaacactccttattcctttcaagtaataattttatattgacaaaactcagtggcttgcaccaacaatcatgtatatttatatttatgagtctgcaggtcaggtacgctttggctgatctgtgctgtatttgactgggtgtttctgcttcaggtcgtgggttgtgcattgtctgggccatggttggggtttggatctgatctccatgtattctttctgtggtctaagccaaaggggcagcggctacccagtgcatacacttctcatggttaatcaccagaacatgagctaaacataaatctatttatgatttttgcttacattatagccatgcaaattccactggccaaatgaaattatatggctaagcccaaagtccctggggagacataaggtattccactctcagtggaagggagatgggagtgaatatttgctgaacaacagtctaaataaactatcatattaccccaaaacttattaaacccacacgtttattaactgcctcattcttaaatataaaaggatagccaagtattatcctgtatttgaggaaaacctacaacataatggaaagtccaaatcagacaaacaagaaaggaatgtggaggaaactgaggcaacatataataagcaaaggaaaacatttaaatactgtatattctaataggtaaaatattatattcatagattaaaattagcatgctatgtaaaaaagtgtccgtaaaaacaagaaatagctcatagaaatacaaaatgggtagaaaattttcttaacgttcaaaatgaggtgtcatcagtcaaagaaatcttccagaagttacaatcagaagacagagatggaaaatataagaaaatgagataatcaatccaacaactaatgtcctggagctaaagtgtatggcattaaaatattttaaaatagtagaagaaaacatcctcaaactgaaaaaaataagccttcagattgaaaaggactcactgaaaactgcgcacaaggaatgaaaaacagctccattccaagattcagcattgcaaaatttcaaaatgacaaggaaaaagagatgactgtaaaagtttccagaaagaaaaaaatgtaaatcatagaccaagtactaagaatcaggatggcctagggattttcagttgtactattaggatctagaagacagtggaatagttcttaaaaatcctgaatgaaaactaatttcaaaatagagttttatacccagccaaacaatcaagtgtacacatacaataatagcattttcaggcaggcgaatactcgaaaatgtgtttttcgtgtaccttttcttattaaagctacctggagattgtacttcgaccaaaaaagggaataaattgagaaacatgatgacttatgacacagaaaacagagaaccctaaaagagcatagggaaggcttgacagaagatagagatcaaccaggccatacataaggtgccaagaaggatatatccagttcttaaaagaacatacactttatctaatatgttcatttaaaaaaaattattgatgattgtttaacagatatgtttgaatatttgggggaaaatgtcagttatctagaaaaacaaactattaaaaaactagacaattctagaaataataaaatgatacataagaaaattaatttaaacaagataatgcttgtctcagcagtgagcaaatttttcataatcattataatgtaaatgaactactgactaatgctttaaccaaaatcattatatgggagcatgaggtgggtatgtagggtgggtggtgcgagacctaaattgtcacccttcttcacgtaagaaaggtctaatattgaaaacttaagaaatagcagtataagtttgtcttttaaaaatgtgaagataaacatcagaagaactaatggtgcatgccattggagattaggtttgaaatcggggaggtagaccatgggcactgctgttccttgttatgagccatttaatactatgtaacttaaattaggtgcattactttgatgggcaaatttaatcaacaataaaaagaaagttaacatatgcccatgattaagaaaaaaacttcctacagtgtggagggatataaatgaacagcatcaagtctcccttttccaaattcgatccccagtactgttttcttgcagtgaccacttttaacagtttctactttgagttgttctggtggttatagtcatgacttgaaagataccttttgataaggtgtaaagctatctggacctgcctttgcccagttagccaaaagatggccacatcaaactgcactgtagacatgcaggttaatagtgtgctttgagagtaatgtacaattggcctatggctgttgttggtctttcatccccaagctactatatacagccagggaagcagccctgacctagttgggtgaggcaaagggttatcctgccagtgggagcatggcatttctggcaagagatttctcttctaacggttggacttggtgccatggcagattttcctgactcagggagtaagtgttgagccctggtccagctggttagattatttgttgattttgattatctgcaccaataagctctttcactggcatggataatcagaagcaggcagtaattttccatcttcctaacaaaaatgcatttcacattttgaaattacaatagatgaagttttattcagttttcaccaaaatactgcttcattgagaagggggaacttttatgaattaaattgagaactctttagagatagtcatatattcttaggtgggtcattttttcttgtcactttgctgttcttgaaagacagagggaaaaatcagtaataatgatatttgctgtcttttagtcagattttactatgtgctaggcactctgctaagtattcctagcctaatttaatcttcacaacagctttagaagcttgttatcactccgattttaggaggaagaaactgtatgatagtctaatgacttgtccaaggtcacagaaaagtgccagagctgtgtctggagccctgatttgcgttggctgttagacccatgttctttacctctgtgtttggactgttttggcaacgcaacccttgactttttattacatgaggaaaagaaagcagctaatttgtacttaaaacctaattaccagtgtaaggtacatatgttgttattgttgcatagtgcttacaaaaattgtatcttttctttttaaaaaagttttgaattttatacattttctattctgtcattcttttgtcttctctcaattcaaaattccggagtaatctttggtcttctgattcctctccttttatttccataaaatcaccattttctctttatatttctgttttaagtccctccactcctcatgtctggaatactgcaattatcttttcatggtctcccttccgccattctttgccaccttaaactgattgtacacattgatccagttttctcaagctcaacctctgtcatattgcatacctgtttaaaccattaatgtcaccctattatctataagaaaaatgtagcgttattaatctacaattaaagagctttcataatgtgatctaaagtatcactccggagcttttgtgcccttacttctttctcacttttcttgctcatgctaatatatccctcatctggctactgaggcatgaattttctctataactcagttggtgtttttatatgctttgcattttgatagtcttcttgtgtatctatgtctcatttacccagatgaattattaactactgagtttagagatgggaactctgaattcatcatattatttagtatagtttcttacatataggactgtgtaagaaaattaatgaataaatttttgaagttttaaagttaacctataattccaattctgtatttctttgcttttgttaattttataaatgttaaacaatacaaatttaatagtctttattatttttatctctttaattatatttaattatgaaattggaaatatatgggtataactttaataacacagtattttaaagaaataagtcagtttaacttagtattccaatttgaaagatacagaaaatctacagtgaatgaaaatgatacaattatttcacagtttttcaaataagccaatatttgagaactgtactaagttattatattgttggttaatgtatggttttgatggagataaactgaatatttatactgttatgaattcaagaaaaaatgtaaatgaattatttaatttatcttccatgatgtatcaaatgtagttggagattgttcagaatattgaataaggacatgaggaaatttggaagtttatttaaatactaaatttaaatccctctacttacacatgattttgttttccaaaaggaggttgcaattttttctgtatcaaatttgcttcttgctttctgctgaatttgaaaatgtttctgccctttctttttttttttcttgttttaatagcctaaatatttttaaaggttcatcttttattttctttggcttaattttacagatgttctattgataaataaatatttctactttaatatataaattatttaaaattatggcctatataagatatttttgctttgaaatatttgagtttcagtaagataaggataatttcatcccgaaaccaaaaaataaaccttcataaattttatatattcatatttgtcttagagtgttcttgttgactttttaaattgcaaatttaaatggaaatattattttagctcagaaatctcatacactctcaatgcttaaatttctcatgcttttttttttcctggattattttttccaagtaatattgaacatcataatcatgccattttttacacctcacatttttcgaaaatctctcttatttattttacctttaatttgggttttgaaacacccaaatgaagccataaatttatcttttagaataaaaagtacatacttgatgtaaatcactgcatgtgtctgattgaatctcacacaaaaatgttactttttaaaggcagtggtattttaagtaaatattactttttaaagggaacgactcttagaatgaaagtgcaattatccactttgactactctcatttaatcatttcatttttaaaattagatttcattttacaatccaaaataaaacctcattcatgtgcatttttggatgtgctaattccttttgtcataaaatggaagctagcctaaattttctaataattttttatcaaattgaaattcatggcaaaaaataaaaatgagctaattttgaattcaagtgcatgtattttatatggatgctttttccccttctctctacctaaggaaatagagaaattgagaatagaactggatgaaagcaaacaacacttggaacaggagcagcagaaggcagccctggccagagaggagtgcctgagactaacagaactgctgggcgaatctgagcaccaactgcacctcaccaggtactccctaatcccattatgcgccatagcaccgatttcattccactgatttttgccacaggcttccaaacagttgttagagttagtcttagtcattcaattcacacttagctttcaggcatattaagaaaagtggagatgtggtaagcaaaacacccagacatgtgaatgataagtgtggcagggaattactgatagattacaaaacctttcatctacaatgctcaaatatttaggtgattctctatcaatataagcgaaatgacatatttctcctaccaccactactacctcttctgctaattctacgtctaataaaaatcttgaactgaaggatgtgaggaattcatttaggaaaataataaaatactgtcagtggtgagagagacaaagtaaataaattgtaagatgcaaattgaaatggaactgatacaaaataaggaatctgcatcctaaggaggtgtaaaattttgagatgaaatagattggcactgctcatgttcaaatcattattataaccaggcttacaccattgaggtttcaaattacttcatttccatcatgagattttgtgatgtgatcatcattgtcatcaactttagtaaatatgtagctcggccctaaattacagtaagactctttaggttgtaagcattgtgaatttgctgcattggaaaaaaacatacacacacatacacacacacataaatacacacatggaaagaaaaattcaaaagagaaagtagatatttcactttatcatatgtggtttcttttcactttgagttttattacgattttgcagtgttcacatcaagcctttggggttgctcagttcttaaagtttttcagtttttagagagaactttgtttaaataaacatgtaagttcatgatatttggtttggtttataaattagaaaaacattggtcttccaatcatagtaatatgttgaatttaaactatgaaaggggactgatcccttttacattaaatatgacaatgtaattctgagcacggtatgctaacagatggagaaaagcaccacttgaacagcctgcgtttggagaaaaaaatattctagaggttggtgaacctcccaaagttttgggtgagtgttaagatgcctctggttctgttaaaatcaaaccttgtataaaacattttgttatgataatattccaaatgatttgacatcttcccttttaaacaataaaagaaagaggaaagaaagagaaagcaaagaaagaaaataaattattaatacatgtctggtatctagaaaaaaatcctaatagatgaaacacatatatgagaaaaaaattgcttaatattgcagaataataactgttcttttaatgctcatttaaactattgtcattgtagaactgagaacataacgttagcataattcctgtggctatttaatcttagaagtttcagaatttagcttcatcatggtaatgttaatagtttttcttttctgtcagacttctattcagaaccaaccatttgtgtgctaagcactgctaaacctcagaaataggacagcttttaatgtctcagtgtggctgagcttcagtaaataaatattaatgctggttttgccccttttgccattctgtcttattcagagagttaatttctgaagtcaaagtccgtagagagttttcccgtatagtatcaatttatagtgtttgacaagatcaatttcttgcaagtagagcatattaagatgcagcaactgctgaaaatggacgagtggtaactaattcctttgttcttaagaaaaacggttttgcttggttccatagaaagctttttttttttgttgagctttatttaaaccaattctactaaaatttaaacgtagttttacaggaaataaaaattattttctaagtgcggtactcttttgtaagcattttatgcttagtctatattcatgttttataaaatccacattcataaatttaaagatgacaattagaaatgcaaggaactgtgtatatctcccctttgcactgacaatgtgatttggttgttgggctatttctgatatatagtacttttttgtttttttggtttttttttgaagtttgccacccctcaccatactttattgattcagtatactcaggtgtgtgactgagaaatgttgtgtcgttctttttcagtgtagatcagctgaaatacataactcccacgcagataacaccttaccacacagtctcaacttaaacacttcaaatggcatattctaaacaaagtttaaaattgaatatgaaaaccgtgtttaaagtaatgatgaaataaggatccaaatctttagaggcaaagaaaatttaaaaactgtagtagagatctgtacatcaacctaaaagaaaaatagcctaccacttttttggtgtttctccttatgggattttaaaacggtaaatagaggccaggcgcagtgctcacacctgtcattccaacactgtgggaggccaagacaggggaatcacttgaggctaagagttcgtgatcatcctgagcaacacaatgagaccccatctctacaaaaaaacaaaaaatattagtcaggcatggtggtgcacctatagacccagctatttaggaggctgaggatggaggatcacttgaactctgaggttcaagcctgctgtgagctgtgattgcgccgctacactccaacttgggtgacagagtaagaccctgtctctaaaaaaaaaaaatggaaaatagaaatttagcattaattaaaggacccaaatgggtgagtgtaacattcacttagtcaacaaatatttactgagcacctactatgttttaagtactttgcttggtcctaggcatagagagaaaaaataaaactcagtttctacccttagattgcgcatactctagtaaagaagctacatctgtatatgcaaatgtaatagactgtgacaacagtgcaatgataaaagtgatgattaccacaggagcacatagggagggggattggcccattctacaccataggtgaaggcgatagtcaaagaaagctgatatcagggaaagctgacagtgaaaagggatagtcagggaggtggagatatttggcagcaatcttgattagtgagttcatgagtaagaattctgaaagtggaagaaagtgggttgggtaccccaggtagagagaccaatatatacagagacataaagatgggagaaaacagaaactctactatcagattaggtgtttggtaggagataagactggaaaggggagcagggaccagcagaagagccttatgggccatctccggagtttcgcccattctgagttactcttaatgcattttaggcaggagcgtcaacatgattgactttctgggttgggagctggactcagagagcagtgtggaaagtgagctttgagagttgatctaggagacaggaagaccagttagcccaaggtcagcaattgcaacccatgggtcaagtctgacccatcatctgtttttgtgtgaccattaactaagaatggtttttatatttttaagtggatgaaaaaaaggggaaacaatattttttgacacataaagattatacatctataaataaagtttgattggaaaatgctaccattatccttcatttattatgtatggcactaccacacttgagttgaatatggtcctcaaagcctaaaatatctactatctgtccctttacagaaaagtgtaccaactcctcaggaggctgtttagttcaagtaagaagtcaagagggcttgaataatgacagattcaaatatgtatttaaagaaggtaattgaagagctttgtgaaaaatggatgggttgagaagagatgactggcagggaccccagttagaatataagcaccatagtccagggggagagtaatgaagcccttggctgtggctgtcccgtgaagtggaaaggaagtagtatcttcagaaggtatttggagtcatgaataagagaggacacaattaaaggtgactgtaagttttctagcccaaattgactagaggatctgttaagccaactgaggaacttaaaagaggtagcagaggaaaagaatacttttcattgtgcaaccccagtggagatgtccaatgttggcttggtgtgaggagaaggtcatgactagaggcttagatctggatcccttttacataaaggtattcattgtagctaagggagtggttaaaagcacatagaaaggatcatgttttaaagaacaatggaagaacagccaccagccgataagactgaaatggggtcttcgaatatataagaaaagaataaagaagaatgattcgaagagtattttcagggggcagtaacaattaaaaccatatacttttcttaggggaggtccccagacagcctaggattgaagaaacctgaattatagtatcttctgtaggcattcactccaggcattctttgcaacttttgacaaattacttaactctttgggcctgcttatgtacctataaaatgaggtgaggctagatgatttataagtttccttccagttctgataatcaatgattctaataatgatttaagacaacccattattaagttcctatatctggacattaggcatttaaattgcttggatgatcttttgtttaaggtatttccttagtttgaacttcagaaagttcattgaaatgaccttcagacccaccacttaaattcattgtaacttaggttctgctgacctctcacaaaggttatcaaaattgtctcaacacccttccagtctcttttgctgaccattgcccggtgaatattcataagcctctgccttgactctgttgctatactctgaaaaccttccatggtgccactctattagagaaaggcaaatgacaacatggcatgtgaggtcatcctgataggctctcaaccttccagtcttatttcatctaagatgaaaccctcttacctgctgatttccagacaaatgtcagtacacatagctcccctttttccctccatttgctgttctctatacctagaatacccctctgaccttctctagctctattataatcttaccttcttaccaaggtctccctgaaatcctgatttttctacctaggcctccccattgattcttgtcagaaaggagcgcttctccccttgaatccttcttcccactttgagctgatggcatttgagtaaatgaattactcaaaggaggaaaaagcaaaatgtggaaaaaaaaagaattaatatttggaagttttttgtgtacttgctattttttgcttctggaatgtgttattcttcaagtaggaggagaggtcttatcagtattatatttctcagagcccctggctcatcactttgcagagttggagctcagtaagtcattaatgaaaatggtgactgtattccaaatgtatgactattctttcaagctcagtactgctatacaaataaatatcttctcacaaatatcagagtacaaagtataagaaggtgataaggctaaaattttttattgagaattttacttgtctctatgatactatattatgattttgtaataatcacttttttaaatttttaactttgtgtaaatatatatgtttaagtatatcagaatcaaatgataatcattctaacaaacaatgcaagtaggtttagtaaagtgcaccaggcctctcacttacatgtacgtgtttaaaaaccacacacacacacacacacacacactcactcttaaactagagttccgcataattaaaagatgacagtggaagccatgtactgtggtgcacacctgcagtcccagaaacttgggaggctgaggtaggagggtcgcttgagcccaggagttcaaggccatcctgggtaacatagcatgaccgcatctctgggggaaaaaaaaatgacagtatttgaaacaagtgcctcgtaagcatgttcactaaacacgtctagcctagcatgtatgaaaacaaagcaaggctgctttcttccagttattactgttaatattattcaaacaacttcttctttttccataacagactttcaggtacatttaaaaatgttcatccatttattcacccgttctacatggagcattttctgtcataagacgctgtgctagggatgaagggagatagaaagataaagaggcctcagctgctgcccttcagaagcttacaggctagcggggaagagaagaaaatacatgagtagatcgggtgtggtggctcacacctgtaatcccaggactttgggaggctgaggcgggcaggtcacttgagccccaggagtttgagaccagcctgggcaacgtggcgaaaccccatctccacaaaaaatacaaacattagctgggcatggtggtgcgcgcctatagtcccagctgctctggaggctgaggtgggaggatggcttgagcccaggaggtcaaggctgcagtgagctgtgatggcactgctgcactccagcctgggcaacagagcaagaccttgtctctaaaattaaagaaaaaagtaagaaaaagaacatacacatgtagtcggtaagataaatgataagatccagaagggaggttctagaaaaggattacagggggagagacagattacttcttactgattttggtaggatttggatataggaaaatgggaatgaagggcattccgtgtaggggaatcgatggtatttgggaggtgtgcatgtatgtataagagtaagttaaatacagtacacacagcgatcaaacagacacctaacaagtatcacctcggaggttaagaatatattcatcttaggccgggcacggtggctcatgcctgtaatcccagcactttgggaggccgaggcgggcggatcacctgaggtcaggagttcgagaccagcctgaccaacatggagaaaccccatctgtactaaaaatacaaaattagccaggcatggtgttgcaagcctgtaatcccagctactcgggaggccgaggctcaagaatcacttgagcccgggaggcagaggttgcagtgagctgagtttgcaccattgtactccagactgggcaacaagagtgaagctccatctcaaaaacaccaccaccaacaacaatatattcgtcttagtatctgcgtggtaccacgctacatgtagcagctctttaaaaaataatagagttatagctaacagcagtggctaacatttgctgagcccctgctgttccaggaaccaagctgagagcttctcatataatcctaccaatagctctataaggtacagactcctattttctgtaatttacagctgaggcaactaaggcacagagaaggaaaggagtcttctaaggttacacagctgatatgttatcgaagcaggttttgaaccccagtaagttgcctgcaaagcttgtacccttatccattaagctgtaattctatgtaaattactagagaaatggattaatgcagttgttctgaaaaagacaacttagaaaatcagtaacatgaatttataatagaaataaatgttagcttcttccggccgggcgcggtggctcacgcctgtaatcctagcactttgggaggctaaggcaggcagatcgcgagaggtcaggagtaatcccagcactttgggaggccgagacaggcggatcacgaggtcaggagatcaagaccatcctggctaacatggtaaaaacccgtctccagtaaaaatacaaaaaattagctgggcatgatggcacacgtccgtagtcccagctactcaggaggctgaggcaggagaatctcttgaacccgggaagtggaggttacagtgagccgagattgcgccactgcactccagcctgggtgacagagcgagactccatctcaaaaaagaaagaaagtgagagagagagagagagagagaaagaaagaaaggaaagaagtgttagctgctcccttatgcatgacacgtgacggtgaattttggcttgaatttttcctaagaaacatagtttcccttggcccattatttgccattgtcatttaaacatattataatgccattgtcattctactttactcccttacttaattttcacccaagaagaaagagaggcttttattaaaaagtagaaatttttcaagtatttatttttgacatgtccaaatatctgtaaagagctataggtatcacctcggaggttaagaatgtattcatcttaggccaggggcggtggcttatgccgctcatatgactaccatttatacacacgtggttgggttaatttacgatatggctgaataaagcaaccacttcttaccgtttatgtgattcttattaactgcttactgagacattcttttccataccttttgcccatgtactgaaacacatttttttaaatcctgcattttttttttcttgtatctgatcttgaggggaactactgcaggaagctttcttttgtttattatccagagaatttagaactcggattgccctaagtacaaaaccttaaaaattcttatttctccttttacataaatgatctttttaataatatgtatgtacttcaaagaatttctcagagcaggaatctaagtgagagtccaccaaacaggtattatactgtgacctacttttgtgatccagatgggaagatctgacctgtgacctagagagacagcaacttgacctataggatttgtgtctttttgaaagtgagaaaagggtacagcagaggagtcactaggttaacctgttatgatggatagatcatgtggggagagtgatagaggctgcctttccagggctttcagtttccacatagtaactagtacagttacttatttgtttctttaatttgaagcaagagtcttgctctgttgcccagcctgcagtgcagtggtgtggtcttggctcactacaacctctgcctcccaggtccaagcaattctcgtgtctcaccctcccaagtagctgggattacaggtaggcaccaccatgcctggctaatttttgtatttttagtagagacggggtttcaccatgttggccagactggtctcaaactcctgacctctggtgatctgcctgccttagcctcccaaagtgctaggattacaggtgtgagccactgtgcccggcctctagtacagatattttcttgaaattaattgtttgacctcccagcctatccatacgagtcaggactttttgggtgaactgaaatccaaaaaggagaaattgataaatttttataactagaccatgtacaatccaggtgcagctggactcagggtttcctggagccagcatgctatcatattctaactttccagaacagggctcaatttctatctgaattttgctaattctttcagattctttcataccatgaagtaaaacatctttcattctgaaattgatgataaaggaaatacctttgatttcaaactgtaagaatgtgacttcctagctccttcacttccaatttcaaaacctttggttaggatcacccttgggcacacacacgcacttttgggtgctgtggctggtagcctcttcagaaccacatggaataagggaagaaagtttcactaagtaaggggaagtgctcttactaggggaaaggtgtcagggatcctgggtgagtaaaacaccaagtatctgcactgttgcccttgttgtctttttaaaaatataatccctggtcaggtgccatggctcatgcctgtaatcccagcaccttgggaggccaaggtgggaggatcacttgaggccaggaggtcaagaccagtctgagcaacataatgagaccccagctctaccaaaaaaaaaaaaaaaaaattaaaaaattagccaggcatggttgtgcatgcctgtagtcctagctatttgggaggctacatggtggtgcgcgcctgggtcctggctacttgggaggctacgtggtggtgcgtgcctgggtcctggctatttgggaggctacatggtggtgcatgcctgagtcctggttatttgggaggctacgtggtggtgcgtgcctgagtcctggctatttgggaagctacgtggtggtgcgtgcctgagtcctggctatttgggaggctacgtggtggtgcgtgcctgagtcctggctatttgggaggctacgtggtggtgcgtgcctgtagtcctggctacttgggaagactgcttgagcctgggagtttaaggctacagtgagctttgattgccatcgcactccagcctgggcgacagagcgagactctgtcccccctcccccccccaaaaaaaaaataataaataaaaatgcaagtcctgatttttcctctaagaaatggtttcaagtggagagaggggagtgaagtgcacatttttgtccatgtatgttggaaaatgatattctccattgtcaacatgtgataagtccaaagaggcatcatcagttcttcacaacaacagggtctctttgttgttttacttagaaaactcttagaatataaaaagaaagaagcacagctaaatctctagcatgcacatgtattgtgcttggtttctgcatagtgctgttccagctgtggcccatgatggctgcttgttagtgtctatggcaagataagtaccggaatctacagaagtatttggcaaattttatatcaattttaaattgtcacaattttcaagcgcatgatcaatgagctttttttgggggagtatcttttaaatttttttctagtaattcatttttattgtgttttaaaaaactatttgcaaaagattagaaattaaaacaaatatgctgatcatttaccacaagaagcttgagatgctatgcttctcactgcttccagcaagcctaagaaaaaacagtcctttatagatgaggaagccgagcctccgaaggggaagcttgaggttgggcatccaggagggaggagagtaggcaggggatgaagggcaaaagcttgtttcaaactgagatagaaacacttttggtgttgtaaaatctcagcacccagaccaggaagcaggtctctttcatctctgtgcccccagcaccaagtcaggcactgggtgtttagcagattttctataaacattgagtaaagttccctttgctctttattattgggaaaattaaaacaaaaagttggggggaactcatcttaagataacaacaagcttaggtcaaaaagccaaactcattatctgtttatttgaagaggatattataacattgatgtatattcttgctattttacagtgaactttatcttttttttcctcctgagttttattcaagaatttttagcctaaagtttccatttcaaagttaagctcatttttttcttgtactcctttcatgaataaattaagcagagaatgtgtcaaaaataattttaaatggatatatgtgcaaccaacatcttcaaggcttgaaatagatggccttggtgctgttttaaattgcgtcctcttttccttcccccacccagtatcagagaaaacaggctgtcagaaagccagaaaagaaaaggcatttcattttgctctggtggacaccacactgcctgagcctgctctgctccacctgtttgaagggctaagaaccctggtctcagtgtggcccggggcgggagaggttcgaaagtcaggcagtgccaggaaatgtgtgtttgcaggttctgcttaacgttccctggctcgctcctctcagttctgtgaagcccaaatgtgaatgcaatgaaaatctccactggggatgcactcatctcccctgccacataggcccacagcctggagcatggtggcagcggcagccaactcatttcctgaagaagcccagaggaaaccgagaatgtattgcccacaccacttgcctgactcaacaacaatgagcatcaggttcaatgaaaataggaaagaaaaagcaaaaacatagaattgttctcatagtagccctaagccagagtatgtctctaaaagaaagttctgctctccaatattatttttaaagtaaaaggaatataacaaaagcccatcaccttgatgtttaatttcttccggtaaatttctaaaattaattcacattcttttatatatatttttagaggcacagtctcgctgtattgcccagcctggcttcaaactcctgggctcaagcggaactccctcctgagcctttcaagtagctgggatgacatgtgcgtgccactgtgcccgcctttgatatttagtttcttcttaaacacctcctcctagtgaatgtgttctttacatcagttgttaggcattactgccttgttatttaatgtttccgtgatacccacaaagtacatcgtgatttgttgattgataaatcttggaattaaagctcattttaaggatcctgagcaagtaagaggcttagggaatattcagtctcctcagtgccctctcccaagccatgtctcatgggagaccagggcccacttcaagtaaacacatttttattatgctgcaactctgttagagccaccaagcaaaggatgcagtcagtctcgggagatgagagtaggcaccaaacaggtcagaaaatgtttggaagcagcttgccatctagctgagctaagagtgtgctccaccttggctctgtgtggcctctccccagcaggcagggtcacctgtgatagggctgagcatctcctgccttgaccaagccatggagggtagagagagagagccacaggctgcttggttttcagaatatcaaagggattccttccccagggtgggcaccagtgaataagcagggcatccctttgacacctttcctgtatctaacttcaagaagcctattcctgaccaggagatttaccaaaagaatgaacccagtgttgaggaaataaccattagaaccatatgaacaaaagaggtaaacaaaataaagagcaagtcactattggaatgtgtgcaggaggtgggggtggtaggcggtcaaggtgaagcattcagagtgggtttgggcagtggtttgggcagtgttccggatttgccctttgcccagtagctcatctgaagtgtggctcaccaggcctttgcctggtagctcatctgaagtgtggctcaccaggctggacgttgcttgagcttgacagtcgtcctagttctatttctgattattttttgtcaccttggggaaaatcccctattgtacttgatttcctacagaccttaactgtgattttatgaggatatatatgagtatgcaaaatcattttaactcattcagcgttttgtaaatctgaggcttatctattcaggtactccaatgattttaatatgagttcaggtaaaataaattaatgagtagtcagtgtattgatccgtctagaaaactttagagcaattaagggcatgaccacctgactgaagctctttatggcaaggctatttggggcacagagtaatatattgttctttctacatcttaaatgatcctctttgtctttagaaggcaaactatcttgccattcctgatatcaactctttgtcaaaacaatatctaatggaagcagctctgtgccctaggggctctgtaagttctgctttgttacagtgatggcagttctctattcttagcctatttccgaagtcaggcatttgttcggaatcattcactattgaattagttaacaacgtttggtttgaggaaagatgataatgatattaaggaataataaaatccatctacagtgaaaatcgagcccagatcagaactgtggaggaacccaaattcagatcctacactcaaactgatttgcacaaagaattatctgttaaaagtgggaaaaagaatggcagcatgcgacaactcacgtaactaatcaactttttagatgccgtttcatatgtttgcttttcattaaatgcaggaatggttgggactatgttgctgtgattcagtcaacatttattcctatctgtttttcatgtacaaaggctgagggatgccagcaaataaactgttaacggagaattaacttctttggcatgctttcatacttatcttccaaattaaagaaaatgaaatgggcagaaacagagtgtagattacctcctttttgtcaaaaatggtgggaatttgaaaattaataataaaaaagggaacagatgcagtaacatgccagagggagattaatgtggagagtaaaatctgtgagcaacaaaactgaagcaaactgaatcagtgggaggtggttgtacaatcaaaatcaggataaaagagaaattacaaacaaccctgcacttgtcaaagtagtagtaatgaaatcctgactctgccagcagtgagaacctgtgttagcactttggggtaaggatggtagccgggtgccaggtaggagggcagtgttaggttgctgggcagcagccatcttgtgtagaacagatggcaccgaaagctggcaggggaggggctccttagcagaactaatcagacagtaacagatagggcagctgggaagactgaccacagagagggagtctgcggggtagccgagtgccatgatgtttgcagtggtgtgcccattggtctgagataagaccttgcaatgtctttcccatctacagaagaactgaaactttgttcaaaaaggaaaattgagttgaattgtgtcaaacttggagggtgggggtgggcattgggatagtgactgagaaaggaagaattgtccatctctgaatttgtcctgtgagttttcagttccagctaccatggaaccttgatttttgctgtttgtatggttctggcaatctaatgtatacagtgtggcacatggaatgatcactttatacattttatgcatcaaaaagtttgcagtatcaaggctatagttaaaattagaaaagattttttttatatgctttctaccacatatgtctttcacaaaatgaaaaactaaaagcaaccatgtgatacaggcatttctacttaataatttttcataagctcatttaagctgtgtttgattcagagtcacttgcccttcttttttcccccatgtaactgtgggttgaacatcaaaatataagcataattcagagccaaaaaccttaagacaaaaatcaaaccaactcattctgcaaataaaagagaaaactgacctgttaaaatttgataacttattaagtagtcgtggttcttgaagtatagagttgggacgtttgtattaaaacgacgactttaacaaagaaatccagatctcctacatctgcttttgaacttgtctatttcttttttttgcagaaggtttataacttggctcaatttattcattttggagggggagggggaaacattacaggatttgaaataggtggtataacatagccatatgctatttatgcagcagtttctgcaataaatctaatttggtgctgtcaaaaaattagacttatttgatatagcagcacattagtaaatgattgtggcagatttaaagttgtcatttagtctcttcttactcttaacagaatctcgcaaattcattttcccccttgatcaactctatgaaaatatcccagttctttgtcctgcagccctgaaaatatttccacatctgaaagaaggtcttgccttaaggtaattgaggaagggggtggaaaaatgaatatcctctgtcgttaaaagacttcataaatatataggcagaaaaacaaataaaccagagaaaattacagtattttcatcatttacagttcttagaaaaacagaactgcaagtctcattcagaatgtagataaattaaggtcagttctttattaaggagtttaaatattttaccttccatcctacgtccatatgctgttttaggaaaactgattattaaagaatgtgagtgacatcagctcttcgccttcacctagcagcgcccttagaaacggctttactcttcggtagtgtaacctggcaacattgcttcaatgcctctttttctgttttttttttttcccctgtaaaatttgtgtttcaggtgttagtatcaaactatctaaactttttcctagtttttctgtttgaaagataagataagcaatgacgcattaagcaggtaaatattaacggtgttctctgagttcctgaattagtccatttataaaagtaatgatttcgtttcccgtttctttttcttgcgtgtttatggaaaagtgtatgtgtgtatcgcatttacgtgtctgtgtgtgactggaagtgatgttaaaactgagtgcttttcatttgtttatgttcgtatcatacaaattatccaaaagaaggctactagtgtgtttttgaaacgcagtttactcagagtgaagagttccttcacggtgatttaagcagcctctattaaactagcatcttgcaaatgcttctttcttttatacagcaaatcagaccatggaagtgatcaaattaccaggattgtttcactgctattcagaagcagggatccaggtgaccaaagtactgtcaagcacagattacactaaaggaaaaatatccagaaaagcagtaacaaacttgctgggaaaacttaatcaatatttttgaaatttcctccacatgaagagaaattatttagaaaggatgttttaggaagatgaagaagaaaacacctcctagaattcatattttgagtagaaaatccatacattaaattacattatatattacatgagaatgatttatatgacactgggtattttgaaggtcagcaataaaattgaaattatagctaagaagcatgtctcagtacttagattttaacctatctttttgattttgtttctgtttttaatttagcctcacaatttttaaaaatatgtctgaaaaactgctttgataaaatccttttcataaattataactgtttaatcagtcagaactttaagatttaaattttaaattccacgttttctccactgcttttgttaataaatttgacattcaattttatatcaataagaaatatttaatttttattttttctaaaaatttagaaaattttacagacttgattgattttacttgatacaagcatctgccataagattaaattttgggataatccttcaaaatataaaagcagccttatgaatgaagtgccatttaggttcacgtttaagttcacatttgtaacagtgttacttttttgccatatattttctcctaaaaaatgatcttccattttcttataagaaatttgaattgagtcattggtttgcccttttcctaaagaatatgatatctaaaataccagtaaataattcaacatagagtgatttcatgtctgatttatgaagggagagtaaatacttgatagctatagatgccacaaaataaattcaattgagagtataattttcacctaatttctatgagtttatttttttcacagaactagactattgatacaacttacatttctttagatagattatgtgtttgcttggcagcatatatttgaacattagtgaaacagaactttgttttttaaatgatggaatttataatatacatgcattgatttgtatattatgggttaagtttttcaaagcagtaatggagctgtgtgttaatatatagcttataattgaaatggtacatatttgtacattttaagcctttcagtgtaaaatttcttaattggaatactctctcccttggctaattcattagtgaaaatatttattcctcaagttaatgctatatagtatgatgcaatttttatatagtgtaaacttgtttatgatattttgatttcactttaaaacttttattttgcttcttagacatatagttcatactcagtataatgagaagtgcagacacacatgaagaaaatacatatcagctgtctggttttacaaatgatcattaaaacaccatgtcttactactttgactccaaattattgtcttcctgaacccaaaagtaattttcacaagtacattacacaacagaacttcatcttctgctggttagcagtagaggatttaaatccatgccgacagttcatttgacaatgaccttgaggggctttgcttcttgaagaagaaagcagaagcttgcggtaaacaaagttcacttctgacagatggattgaatgacagaaaggttgcgagtgccagaatagccctggcagaggaggaaatgttcagtggaatccaacaggagaggaggtgtgaacaggtgcagggttgctgacggaaggggaaccagatggaaggagccagagccagtttatttaaaggaaaaggcagaaaacattgaaaggctgtgcgatcagtggctaaaagtgttcatagaggaaggtaaaaattcacaaagcaaaactgcacagtggggtagctaacacttagcataatggtagtaatttgtgagtttagtttggaagttgcgattgaaatacattcatcttggctcttgacaccatccagtatagatatttgaaagttgtttatttttttaagtttctaagcttttttaaatccatccattaatttaattttttccagccagaagctccattatgataatactaaaattatgtcgtcagctaggaaaagaaaaaaatttaaagtgaaggttaacgttccattcaaatttatcttgtgatgcctcagttttgttcacatatggaaagcaaatgcatgcactgttgggtgacatctgtaatatctaagaaatttgcaatgttagaatagatgccgttggttgcttttgttgttttggatctctgttcattttgtgaagtccggtttgattgtttcagtaggaataatgctctttaaaatacacatttgctggccacaatctgcaggttaatttctgctgctgaggttgacctgattttcattgactttcagtgacctgcctttgggcagacacctgcaaacccaagtacaatttacaaaaggaacagtacgcatacagtggagcaagaaatgaggactttcttgttttctaagacctattaaaatgtaactttctccactgcaaaccagagatagccctgctaatactctgtgtggtcaattcatacataccacttatgtgggcccttgtctaccacagttttccttgaaaattttactacattacatttctgacaaagagacgccaatagaggaggagctattaagaagctatcaccgggaaaaatgatgacaatgcacaattattttgaggttttaaagatctcgtaaataatccacaaaagtttctgcacactgctcacagagattaaacacacaaagtaaatgagtactgtattgacattccttttctcagaactgcctggatcaaatagattacgtttgattaaggctggatgttttgagtttagagagaatgtctgtgattcgtggcatgcttttgtcagtaaatataaagaattgaaatcagattaacagttatagaagatgttgatttactcctgtgctgtatatcaagatcatcaattttggtctctttttttttaatctggatgaggcaatatacaactatattttgaaggaaaaatggttagtgatttcttctagtaaaaggaagttgatgacctgtattttaaagtcatctgcaaaatgtacttttttctcccacttgttaaggaatttttatctaataacttcttattaatctaaaattttatataaaatcgattggagtatccttgctttgattatagtgtactgattttgccatctcttccatcataattaccaaatttatttatataataatgctactagcatggtgctgctttttaaaataataacataaaactcacttgaactacggggttcaaattgaaagacagtaaaaagaaactgcaacaatcagtgtcatcatttgatagtcatatcacaaattaaattgtaaacttcttataggtagaaccaatagcttcccagaaatatgtaaatttagttgtacctagtaaagtgtcttttgtgatatgagtctttaatttttttgaatgaagggataacaagttgattgctgctaagcaggtattcagtcaacatttattgagcacatgttctgttctagctgcactaggcactatgtaaattttcaaaataaagagcccatgatccttttccacaagtatcctgcaacctaccagacaaggtttatgtaattacatatacacatacgtgtgtgtgtaaaatctagaaaatagtatataaatttataaactttctgtgactcatgatcatcttaaatgaattgatgaaactctcatctagctcaacacttataatgtgtgagaatgttgagagaagctaagtgattttcctaataccaacggtggttgagtgacagcaaaaagtagagtctaagtttcctttctctaagtctagtgctcttcctgcatcccacattatacttctttgttctcattgatgatatgacttgtctgagaaaccccattaaaacccttcagtgcaagtctttcacagcctgttttggaaaggaaaaaaaaattatttttggattttggcacacggttactggttcttgaaacaaacaaaacacaaaggttctttagcttgcaaacagtaattacgaagttcacttcttagaactttttttaattattatttatttatttatttatttattgctggagtctcactctgtcgcccaggctagagtgcagtggcgtgatctcagcttactgcaacctccgcctcccgggttcaagtgattctcctgcctcagcctcccgagtagccaggattacaggcgtgcaccatcacactcggctaatttttgtaattttagtagagacgagatttcaccatattggccagactgatctcaagctcctgactaggctcaagcgatcacctgcctcggcctcccaaagtgctgggattgcaggcatgagccatggcactcagcccgtttcttggaactacctctgggagtggtagtaaagataacctcccgcataaacgctgcttaccctgtaataggcatattcacttaatccccacataaccctaccaggtagattctgccataagccccattttacagataagaaaactgaggtattcagaggttagtaccttgacccaagtcacagcactgctaagtggtggcgtaggcactgaagcctaggcagctaggctcccgactacgattttatccattacactatattgcctctgatggtggatgttgtgaaaaataacttctgtcaccagttccttttggaaagttgtattcaacaggctaaaccaggtttcttgacagtagggcttctcagcgtttttaatatgttagtgcacactgtgactctcttagaaaggaatttagttttcagtgtttccgaaatttatatgacttatggaagcttttctatcaaatctccacacatcttccaggaatcacgtttttaggaatacacttggggaaaaactgaactaaactaatttgtagtaggactgctgaaaactatcatatggggattattcgttattgtatctcatcagtgcctctgcaacaccctactccatcccaccctgccccgcaacttcactttcattagaacacacacagttcatggaaagagtagataggttggtaactttcaattttcatttagtcatttctctaaaatgggggtgtggggtggggaagcatctttgaccagacttcaagagtagctggacagttagctgtgccagagtcacgttccaagttcttccatatcttactgtcccaactttgcctttatgtgataattctatttattttaaattatgtgtttattctagaaaacaaatttgacaattacataactagattgccagtcagttcattgaagttagacaccttttaaagcatgactctgaatgagatttcatagaataagatgttattgtggatgctctcctgtataaacgttttaggcaatctcctgccaggaattattggcacaaatttgaagtatgggccactaagtcagactgcactagattttattttccttcaacccatgatatggcaatattcctcccttttatgtgtattctttcctgtgttaggaagaaatggagcaactcatgggcaataagctctggaagtcgggaagtttagcactcataatgtgctaatttttctgtaaatacacttggaggtgcctataatttataattatgtcaagcagtttctactggtgaggttttctataaataaccatcttgtaatgataacgactggaattgtgattctcatgaagacttactatgtgtgctcctagctttcccacctgccctgctttctgggttctcaaattacatttccttcaataaatcaactccagcaatttttattaaagtttgaaaccattcactggcttatttgtattcctcaaggtgcagaaaatgtttgggaataagcgaaaactacaaaggcaacagattaaatccccaggcagtgggatagcttactaaactggctgacacattgattgacaagctaatatgactgcaaggtcctcttgatgaactttgaaactagtcgtttcttactagaaacaagtaatgaatgatataaggatgattactagagattgagtaaagaaatccatgtctatttgccatttaaaaattatagaaacactatccaatgatgaagattttccaattttatttacattcacttattaggaaggagtctgtgacccaggtacataactgaacattttaaaaataatttgccagcttggctgtatggattaactttttcataatactttgtaatttaattttaaatgtgaatatgttttttgggagttgcctcaaaccaaatctgatttacaaaaaaaaaaaaatgaaggggatcattttggtatactatggtgactacttcagcttcggttgttcttagtgttctatcagaattcttctcctttgtttctcctttcaaatcataggtgagtggctgaattaaatgagaaacttatcaaggttaaaaaaggtcattttaatagtttttgaaaattatgagttttgatatcttcatgaggcacttacgtttagtagttttgggcacctggttatttttatttgtggaatcaggatttaaaatgctgctttgctatagggtggtagacaaaggagtggcactcagaccagtgctgtccaatagaaatacagagggagccacaaaatgtaaaccacacatgtcatttaaaattttcaaataaccacattttaaaaagtaaaaggaggctgggcgcggtagctcatgtctgcaatcccaacactttaggaggccgaggtgggcagatcatttgaggtcaggagtttgagaccagcctagccaacatcgggaaaccttgtctcaactaaaaatacaaaaaaattagccaggcatgatggcgcacacctgtagtcacagctgctcaggaggctgagacaggataatcgcttgaacccgggaggcggaggttgcggtgagctgggcaacaagcaaaactctgtctcaattaaaaaaaaaaaaaaaaagcaaaaggaaacaggtgaaattagttttaataacataatttatttaacccaatgtatagaaaatagtatttcaacatgtgatttatataacacattattaatgacgtattttaaatttttttcctaagtcttcacacccctttgtgtattttgcacttacagcatgtcttgatccaacctagccatatttcaagtgcttactaaccccacgtggccagtggctgccactccagacgtcacagccctagacgtttgttactcagttttccagctttcccacaatgcccagcagagatgaagttagattctcatgagcttaaaccctgaattgtttctacaaaaatgggaaccattttattaaaacaagaaaatcatgtcatctttttcttgaattttggaggcagtagccaggactcatattgattagtctttttctgaagaatcgccactttgaggaggaggaggaagagagaggaagctaccacttactggccattacttgaagagcagatgagtgattaaatataccagcatcacattataataagttcttctatatcttactctcccatctttgccgttatatgttgaagagttgttgaaaataaatttgacagttaaataactagatgccgatctgttaactggatttagacaattaggaacctttcaaatggtgatctgggctggacgttgccggttgcctcatgtggagcttcccacataatcctgataatatcattttattaatgagaaaacagaggcttagattgagatgaggttccgccttgacgtgacacagctagcacatggtggagccagggctgaggcccagccctgtgtgtgcaacgctggccaatgctacctccccctgtgtagcttatgtcaggaaattgaggaaaatttttattctttcctcaaggctgtctttgagataattatattgattgtttcagtttgagtagtcatcttctaggaaataataaggataacaatagtaataatacgtactaattaatattttttaacttactatatgtcagtgctgtactaacagtattttatatgtaatatcctcatagtcctatgaggagaggtactgttattaaccttatttttcattcaagaaaactgagtcgtaggttatgtgacttacttagagcaggagttcccaactcggggtcacctgacctccatctcctgtcggagcagcagcatcattggattcccatggggcgctaaccgtattgtaaactgcgcatgtgagggatctaggttgtgcactccttatgagaatctaatgcttgatgatctgtcactgtctcccgtcaccccctgatggaactgtctagttgcaggaaagcaggctcaaggctcccactgattctacattatggtgagtgttataattatttcattatatgttacagtgtaataataatagaaataaactgcccaataaatggaatgcagtcgaatcatccccacaccccctaccctggtccgtggaaaaattgttttccatgaaaccagtcattgatgccaaaaaggctggggaccactgacttagggcacacagctgctaagtggaggaattgcaactttgatgctaagtctagcacacaccaaagcctgttctctaaacttctgcctccttgtgtacagatgccctgctggcagtggagcttacatgcgaagggataaaggctgaaagtatcctattgtttttaggggtattttaggatttcagttgcttatatttattttctcagagcacaaagtcctcagtttggatatagtcagggcaggctaccttgtggaaattagtttgaagatagatttagaaggctggaagcagcaggtttccaggaatggaaagggccgctctgtagctacaggaatggtgaggacgaagactaagaaatggctagaggaagagaaagatccagcagacacaggttattgaagcagaggaaataattaaggatgtagataagaatagttataagcaagtattacaaagtcaaatagaaataatgttaaatcataaaatgactaaaaggcaaaatgttttgatgaagaaagtgacttaattattgtatcaagaaaagaattttcttatttagaggaatgagaatagtggagtaggaatcagaaaacttgggctcacgtcagtttttttcttctgtagatgtagtgctttttacctccagaattgtgtgcaaagacggagaggttacagagttctcaatcaaactctaaaaatggactacagtggtcttgttgccaagtcaaggttactagtccatagaatacagccgtaatttctgtatacatgcacattggatgtttgaccaaaggcacaccatctcagcaataatgaaaattctactatctttattacagaagttccccacttactcaaacttagacttcttcttttttttttttttttggttttgagatggagtcttaccctgtcgcccaggctggagtgaagtggcatgatctcggctcaccacaacctccgcctcccgggctcaagcaattctcctgtctcagcctcctgagtaactgggattacaggcatgcacaccatgcccagctaatttttgtatttttagtagagacgggatttcaccatgttggccaggctggtctggaactcctgatctcaggtgatctgcctgccttggcctcccaaagtgttgggattacaggtgtgagccaccgtgcctgtcccaaacttagacttcttgctagtttgaaatatagctgtaaattgaggtataaattaaaacgtacttttaagaagcaagtaactatcacaaagcccttgcacttttctgtgcagcatctgtggaactatcctaacacacttttaggtgttaaaaagcaaaaaggaaaaaaattaaaaacaaaataaaaaaacatggcagcaaatcacagcaaaccaaccaataaagaattataagaagaccagtatgcttttggttctttagaataacatctgagaccttccttgcaataaatattattgaatgccttctgtttctagccactctattaagcccttaaagatctggcaatgagcaacgatccataggcacttactagcaaaaggaatagcaacagtaagtatgcctaccttgttttaaattatgaaccttaattattaaggagagcttattgtatttggtatagtttgcttaagaaagcagacataattaacacattttagacatatttctattgtaaatggcgagaattctgtggatctaatacctggaaaattctcgtatgtggaacatattctcaacattctagataaataatgcatgcattactctgtcatacttatgagataaaatataataaaaaatatataaattataattcttactattatacatatttctgaataaattttatagccacaagggaaccaacatgttccccatttaatattatatcctagaaattaattcctaaaacattttaataatagaataatagaatagaatagaatagaaactgttatgctacaatttgctaataatgcatttccattgacatgttatagaaacgccactagaatgcatattgatcctactgatacctgatttgaagttactcatcagagggattagttactgggaatttgtagatcaagtgatatttttcagagaagaaagccaagaatgcataaaagtcattagtttatacagacaaattgaaatggaaaatatgaatttttgaaaatatgaagatacaaaggcaaaatcatgatcgaatttattttaggtaatagcatatttggccttattatttagggtgatgaattgggctcagggtgttgtataataggatacagtagtgctttactatctcacaggatctttgccccatgcaatcacttaatgcatcaggcaccctgagctattgaaaacatttgaagactgaaaattaatgaagtgtgcattgtcaaatgcactgaggctgttcagtctcagtatctacctatggtatctaccgtatctaaagaaaccattacagaaattgctcttactattgctgtagtaataagtgctttccctgattctaatgttgtcccttccccatctgttccccacactgcagccagagtgatctttctaaagcacgagtgtgatcacaacactccgctgcttaaaaccctacattggctccctatttccctcaggacgagggccttaaaaatagcttcatgttctggctcctgcctacatctccaagtctcgtctttcttcaataatctcccctccaccaactgtgcgctgctgccccacaacatatatcctccagcatcccgtcatgccaaaactgtttgcagtgttctcagggcacctggttatctctccaccctgtgtctttgcacaaactgtccacttcacttgtaataatcttctttatattctttgtatggcagattactactcatattttaagcttctgattttttttaagcttcctgaaatccttcctccctgtccccagctactccccaattcctatcctttccacctgtatcatggcaggaatttagccctactttaatatttactgtaccatgagttgtttttttccccaaaactcgtttattttgttcactagacaatagactctctgaggccagggtctacatcttgcacactgatgcatccccatacttttgtgcttggcacaaagtagttgcttaagtatttgttgaatggatgcgcaatccactgtttgattaaacaaacccatcatgtgaggcagtgccatggaatggaaagaacactggacttggagtgagaagacagatttggattccagctttgctacttactagctgcatggctttgagaaaaatctcttaattcccgagtttgagacactttatctatcaaacaggaatatctgttccatctctctgccccacagagatgttatgaagaatagagaggtcggtgcatttgaatgtgccttttaaaatagaaagtacagacatgcaaagggtgatgcgctagtaactggagttgatagagtctgtggttttgttttaaaagtagatgggaattgtgcatatgtaatagaaacaggcaatagctagtctactgtattgtcttttgccttgaaggtaagttttcaaattattttggagatactgtaagaacatttttggagggaaaattatttttagagatgtttctgttaaatatttcctttcttttgtgtatattcccttgaaagaagttgacctcctttctgtttctgctttcttccctagaagtgactcattctctgatctgataactcatctttcaacattgtgcttgaagttctgacatactttgcaatgaagaaaatagaagtaatttactccaggaaatatgccattaagtcttttgcatacttaaggaagtagagattccagaatctcattcctgtgttttcctttctgtttcttctcagtagttccacatttgctcaaataagggaatacagcccctgttagctgtaaataagcatagaattttgggttcttctgaaacatggaagacatcatgctgtctaccaattttattattgtttttgttttgttttattttcaataataataataaattcttgcaaaaatagagattatcttatcatattctctgactgtagtcagtagacaggatgatacttacacctgtgaggatacttagtactttccgtcttttagtagttgatcattcattcattcgtttattcattcatgaaatgttcattgaccacacaactgtgtaccaggcactattccagattttcgggataaattagtgagcaaaacaaaggttcctattctccatggatttagattccagattgatgcacatgtcttatcttttctagagtctgtggccacttgaggcaggagatgtgtttgtggtacctttcaatgtttttgcaaaggtgaatatatgtcttcgagaaggacacaactaattgatggtgtcattgtaggagaaagtaatccaatagcttaggggacaacagggaaagaagaaggagaactagcttgggatttggctgtcaagatggataatatggctattaaatggcacactcccatatagataattgaaatagacacttgttatcctttcaaccttctctcatttctctacatccctgataaaagaagagactgaagcatagtgattcactgtggactttagagtcagatagccctggatttcctggctgtaacctttaataactaaagaacttggacatactgtataacctctctaggctcccattttcttatctataaagtgaagatactaagagaacctactttatatggttggtatgaggattaaataaaagaatgcatgtaaagaccttagcttatgtgtaaacattagtaattagtagcttcttaaaaggattagtcctttaaggttggattttctttttgttctgcttgaatgaagaaccccagtattaaaggaagaaagttattagtctatagtcacacaggtgataaggtggtagatgccatactctgaccctctagctctgtgagtttggctgtactccattgcctctcaaggtgtcatcttcccagagcacaaagagaataaactcaaaaagtacctatacatttgtttaaaaaacaaggcaaaacaaaacaaaactataagcaaatattgaaatctagttactagtagatttgctttccatagattattaattttgaaactactttctgtgtattccaagtttgaacaaacaagtatgttgaggataataggaaccaagtttcttactattgaggaaaaaattacaattatggaaaaaagggagacaaggttctatgtatgttgttggattgtaattggaaagaccagtatgaatgtgtatgcatatattcatataggatacagacaaatatttatatttatattcacatttatacacttacatgtatattcatatccagacttagtccaccaaggtgacctagaagcaatgattttgcagtagcagtgagcaccacctagtgacagatcctgatttctaaataccattctccattaaaggcacaaaaacagctccttggtcaaatgctgattccaagactggtacaaggacattacaagatgagcctgcaacattttgtggagatagaaagccacgtgaacaatagagacatgtcacgtaggaaccaccttgaaagggttccccctggccaaatccaggataaattgagcataaaaataataatcataatggattataacccactgaataagatatgaatccatgactccatgctgatattaatgaattaataaatgagagagaagggaaagctctttcttataatacaatgttaactaaaaaatagagaaagaataatggagtaaaaaagtcatttttggatgtaaaactattagatgagagctcgatgaagaataggatgtttgcatagtctaggcatctcccaacaaattacctcttacttattaggttggagcaaaagtattgtgatttttgccattaaaagtaattacttttgtgccaacctgatacagagaggaaaggagtaactttacagtagagaggcctgggacagctcacctaactgctgttttgctgagtctgacttgtaccagcccatgagagccaattatgtgtatttcttcccaacttggtattcagtgatgtcactttggtagctgaaaatagagcatggtggaagtgtctacactgaaaattggtgaatactaccaaagagggatttcctgtcccctggagccctgttgttaaatatcgtctggcacaccaatgatgttaatcaagctatcaaagctaatagcaccaatattgggacaggtgtacattttctgtctaaactcacatcggtacccagcacctccctgccccttctgtctgtattccttaatgattttcagccagtaagcatgttataaattctcacaagttttttcataccaatatgctactatcacaaagctcacaaaattttatcttaaaagggaaacaccttttagccaaaagagttgtatgtctcacattggaacttcagacatcagtaaaaaggtgagtaggaacatggaaggtgggattggtgcttcaaccccacaactaccaggtccttgttccagacttgagcctttcattttttctgtcccagggtcattgttgagctaaatttaacatcattagaaaatgtactttaaaaaatctgcttaacaaatcatttttgctctgtgacatgaacattttttaaattgcaagatttaaaataataaacgatatgaaaaagttgagtatcaaaaatataagcttaatgcttcagtgccgtttctaaaaagtgggatggtaaatatcattgtgaccatttttagaaaatgcaatcaaccagaactataattggtaaaaaggaatgactatgcttccatgtatatgtaatctgtgtttgaggcctagccagtacttgttcactcctttaattctgaatttttatgaagaaaacattgacatggcctacatacgcctggattacaggtgatgtgaataacttggagaataaaggtggatgttcctattctagaccatttgctcctcctttaatttatttatttttatttatttttttattttttgagacagggtctcactctgtcgcccaggctggagtgcagtggtgtagttatggctcactgtagcctcaacctccctgggctcaagtgatccttctgtatcagctccttgagtagctggcactacaggcacacaccaccgcatctggctaatttttgtagttttttttgtagagatggattgcaccaggttgcccaggctggtctcgaactcctgggctcaagtgatctacctgccttagcttcccaaagtgctgggattacaggtgtaagccactgatttgctccttttaaagatcagctttattggggtaaatttaaatataataaaatatcaccaatttctaactgtgcaggtaaatatggtttgacaaatatatagaattgtggaaagatcatagtcataacatagaagaacatttatatccacccaaaacatgtccttgtgcccttttgctccctggtacccctctcctacttccaaatcctggcaacgcggatctactttctgtcccttagtgtttacttttcttgaatggcctgtgaatgacatcataatatatgtctttggtgtctggctttttaaactacgtgtactgcttttgaggttcagccaagtgctgtatgtggcattgttccttgttatttctacccttcctagccatggttagactataccacagtttatccattgaacagttgatgcacgtttaagttgtttcccgttttgagtgattgtgaataaatctttcagccccataactaccaagaaattcttttttactcagtgttttgagtgggaattaaagcaaaccaattggagagactggcttgaccatccttcaccaggctctcacacccagctggatttgactctcattttgttatgctttggtaaattttccccttatacctttcttacgaagtattttgccatctactttctgtttggccattttgaactccctgctaggggcaaggagcatgtcttatctatctttatttgacccagtgcctagcagagtgcctttcacataagagagttatgataaatacttaatgcattgatttacattcttctctagttgctccttgaatgcctacgtgctttttataattttttcaatccattatcgtattacctctagagcagtgtgtctgatcttttggcttccctgggccacactggaagaagaattgtgggccacacataaaagacattaatattaatgatagctgatgagctaaaaaggaaaaaacaaaaaggcccgtgcataaatctcataatgttttaaggaagtttatgaatttgtgttgggccgcattcaaaaccatccaggccgcaagcagagtaagctgtccaactggcggcccaggacagctttgaatgcagcccgatacaaactggtaaactttcttaaaacattatgagattttttttgtgtgattttcttttcttttcttttccttttttttttcccagctcatcagcaatcattagtattagttttagtgtattttatgtgtggaccaagacgattctcccagtgtgacccagggaagccaaaagattgcatacccctgctctagagtattataaaataggattccccaaataaaaacattttaatcctacctctgcctttaaatcattcactatgcaacctataagcagacttcaaattctttgtgacccttggggatttttaagtaggttttttttttccaactgtaaagtgagagggtttgatgaaacacatttgaggttcccttttagttctaacattctgggaatttataaaaagcctaccaagtcagaacctgcaagagaggagagaaggcaacataggaaagtggaaggggaaaggaggttggaaagcaagactatgtcatgtttctaggcaatgaaacataatgtatagtttcccaaatagagggaaatttggggaaggattcgagaaacatcagttgatgtgtaactcaacatttgttggtagaagtcttttaaattgttttattttataaaaaggacttcaattatgacagtagttcttttctatagtcaatttattttttatttttatttatctattttgagacagaatctcactctatcactcaggctggagttcagtggcacaatctctgctcgctgcatcctctacctctcaggttgaagtgattctgatgcctcagcctcccaagtagctgggattacaggcatgcaccaccacgcccagctaatttgtgtatttttagtagagatggggttttgccttgttggccatgctgatctctaactcctggccttaagtgatctgcccaccttggcctcccaaagtgctgggattacagatgtgagccaccgtgcctgacctatagtcaatttagaatatcagtaattaggcagcttattctaaagaatgatggtgagattgacaacccctttacattggggaactgtaagtaccagtttgtgatgggtagtttcagttgtgactgttatcttggtataattattaatagtgcccctttcactttcagatgggtattggtgttggagaatgcatttatgtcacccaattgttaggggttgcagagccccagatttctatctctggctcctgccccggcagggggtctgacttggggatggtctgacagggctttttgtttttttagctgactcctttagcagcacggtctccagctggcagagccattagaaccattctcttctaagcacctttttctaacacgtctgaaaagtttttgcctcctctcgtaagacttaagcagattctccagctacacgttaagatagcagccttcctttcccctatgacaagagtataacaacatccaatcatgaaatattcaccacccacttcctgtgtgccaagcactgaggctgggctgagggtatagagagataaagatgacaaacgaagcagacatgttaaacaataactaaagtgtgataaatactatctttgtacgatgtacacaacatatattgaggtcattgagggaagaatagttaattcaggagagaggaaggagaggggaagaattttgagttaggcctgaagcgggtagttgtatgtatacatcttacagggggattgagtgggcaggtggaggggctttccaggaagaggaagagacatgtgcagtgatccatggccagaaaatacatggtgtgactggggaggcaaaaagtagcctagtctgactatccatttgttgtatatactggtttggaaccgagtgcgacgcaagaccttggaccacatcccggggggaggtgttgttattagaagtaccagacaggaccttatttcacatttagcatggacccccgatgattccatttgagtgaggtgtgggtgtattttcattccagaattttatactacaacatgaccacatgcattgaccaattttaatacaggctttccttatgttgctttataattagaagccagtgaattgaagttccacagcggtacatagactagtagtgatagctttatggaattgtttatttttagtttggcaaaggctaagcagtaaatatctcaattagtaaactaaagcagcatggatgagaaatgcccgcaaggagatcaggagttagaaataactaagtcagttaattgaaggaaaccctaatatcacttacccatatttagagtttgaagaaccattctaatatgtgtgtgtgtgtgtgtgtgtgtgtgtgtgcacatgtacatgcacacacacactgtcagtatccacagtgctgccagcattgaggtcctttgcattccccaggttctaattgtttaggaagtttctctctttggagccactgtgcttggttattgacccagtgggataggtcagtgtcctatcacagtacgatgggttgttgtctgactacagaagcttttcatcctgcaatttctttcaatgtgacccacgagggattttattatgaagtgctgggggaagttattcgtattcatatttgtattcatattcacattatatggcctgatgtgtgaagatatttagtgaaaacatgaatgtggcactgcagaatcatttactcgcctctagatagaggctcctgcattatatttaagattccattttaagtttagagtgaaaacagaggtggtctacaaagcttagttttaagaatttaagttttgttcctagagttccagtatctctgggaaagattgaccactcagaagatgaaacattcattgatagtgtaaaacattaagaatattagagaaaaaagttttgtgttttaaagttacaaaataccattatttagttgttatgatgttttgacactgcacactttagtccatttggattcatggcacgtatttaacactgtatggaaggttgtttggatcttccccctaaagtgggggagggtcattagaaaggtccttgtcttcttatgcttaacaatttactacgtatcagctctctctggtctataggggacatgatgggggtttgtgcatctgcagattaaatttctgtatgtctcctctctgttttgcagacaggaaaaagatagcattcagcagagctttagcaaggaagcaaaggcccaagcccttcaggcccagcaaagagagcaggagctgacacagaagatacagcaaatggaggcccagcatgacaaaactggtaggtggtagggaaagattagagcctgggcactagctcacaagtcaggcccacgccttactgtgaaatgacatcaggaacacctgtaacctttggctggccgaagggagcagatgctaactacaccggagattccgaattacatattagttagcgtttaaaagagaaaatggaaagtattgcccactgtctgttgatttcagagtgctgctctcacatctgttgcaccatctggattatgagtttatttacctgtgttcaagaaacgtaaagctgagagagaccacaacaaagtagaaaaacaaagggcttgtttttggctgggttttcaggcacacatgttatataaagaaaatagcatcagaagctctgcgggaaatgctctgagcttacagttagagtctcctgaatagcattgaacagttcccacagtacacacattatagctactctaaaagcctaatgagtttgcttcagcatccaaactggagaaaagctttagccattaatcggttcttaattcactgtcgcagctggatgtaattcagtggctccaaattgatatgttcctttatttaatctttgcagcttcgaacatttttagcatttgtatgatttccccacctcccccaacccaatctagagtgatgtttaatcctttgcattcttcaagttctcacaactgctgttaaaattcactaatacaaggcactgaccacagctggcagcttggctaaaaattgccatctttcatcacattggcactattctgcagactgagttggccagtaactctttacctttaatttgaaagtaaaatgcactttgaaaatagacagtttgatttgttcagtcagagcattatgtagtttctttcacttttgagttgtgtgttcacagacagtgttagtcaaaacaagacagtgtcagtcattataattccacaccacatactccacactgattgtactattaaaacaaaagtttaattgatcctgtctcttccagaaaaatgttgcttaattttagtgccttgatttattttgatttgtatgctatatgctttttgccaatcattggctaaaattgaaaagaaataaaggcctcttaaaacttatgcttagaggtaattttcatatgatttaatgtattaatatattgtatttgatgacacagtaagaaattatttcttatcctatgggtgaaaaattgccaacaggcaagtcattaaataatctatttacttatgaagaggcaaatgtcatattgactcacataattccctctatcactttcagtagagattttcttccaacagcatttggccagaagaaacgaaaattcaccaggtttagtagaagtttttcctctaaaaacaaaaagaggcaattgtaggataaattattgtttttgcccccactgctagcatgatcctagtgatcagagtcttgggcagaatctaagcactagattagaatgtatttaactgttaaaaccgccttaagaacatttccttttgtcttgtacacacatacacaaaatcacactgttttcaatttctttgaccagatctccattgaagctcatgctgttgacaatgaaattaaaattctaaagaaaatacacatttttaccttcataattagagaagtgtatgcaagattgggggtggtggtggtagtaaaccatgtgtgcaaatatgaaacaaagcatgaattacagtgtagaagagaattcctcgatgattttagttttgagttatctggttgtgataatttttgacactctgtttatagtaaaattgtcaaaataaaaatataatatcttgcatattgcaaagatataagcatctattcttccacttgaggtatttgacactttattaacatgttaaaatgttacaccaagctggtatgatgaaaaatgtttctggtgtataattatgttgaaaataaatgactcccaagattgagtgtctttccagatgataagtcctttgacttaggacattgaaggtgatctagtggcttattggaaatgtgtaggggtctaagcactttaccactctatgtatggaagcactgcagagcgacaaccataaacatcttatgttggtgggggtttattgttatttctagaaaatgaacagtatttgttgctgacctcccagaatacatttttgacaaagttaaaggaagaatgctgtacattagccaagaaactggaacaaatctctcaaaaaaccaggtaggtgatgttatagaatactttcaagagcactgtttgtgtgattactctaatttttccttaaaaaacatcatttgcactgttttatagtctaatgtcaaaattaggtatctgctgatgttttctttgaaaatattttctacatatggacattttcttaattgtctatacgcttttatgttttttcatggttatgtgtatgtactattatttgacatttcaatgtttagaattgaaaactgtgaaatttcaggaaagaaggatcaatatggtaataacataaacatgcagataaatcaagcagttataaaatcttacataggtatggttaacacattttaatctattgttacaattcaccatgaacacaaaagctgtctttaggttaaatgataacagatgaaatgtgtatatataaaaatgaaagtagatggtactttgaaataaataaaccaaaactattcttcccttctcctaaaattgttatattttaatagaacagccatcattcattttatagcatactactcttttataaatccattgattggaatcttaatgacttttttctatacactttctagtcagattatctcaatgaataaattatttcatattctaaactgcaagaagcccgactccccatctcagctccgacagtaactgaataatcttggacaaatgtatttgacctacttggactatagtttcttcttttgtaaatgaaagacattggacagaatcactttaaattgaactatagaaggcaatattcacataactgataagatgtcaaatactactttatatgataactcaatgaaaaaattgcctgtgtgtcttcttttctgcatttttctgaaactcacatagatctattgagagcaggaaatatggctcagcaaacaaactactgacctagatgtttcattcgggaaggatttctgggagtatcagggcatatctgatcactctgagctccatcttggaatcctgcatcaacaagctgtcttagctgatagaacccccatccctgaatcttttggggaatcagagggctcgtgcatccaactctccctgctcaccaggaaggcagaggctcctgtaaccaccaagaatgtactctgacatgcgcaccttcctagcgtatactaagattgtattttggtaggggaaaacctaggtgccaaaataccagatatttcaaggaaatttgaccaagaaaaccaaatgattttgtcatgaaagagacccataaaatatcaacagtagctattcttaaccagaaatacttgatttgcaccacatagatccaaaagtaatttgttagaagcaaacaaacaagattgtatcatttagggataaaatgatatcaatctgggttttatataaatgtattaggtctaaaattggtttgtgaatgattagtgatcttgctctccaaggagacctaattagggaaatttattatataaaagagacaaaaaggtgcttggtatgttatttaattctcaccacaacttgaggcaggaattattatcttccagataaggaaaccaaaactgtttaaataactggtgagtgggagagctacggttctaacataggtatttctggttccaaagtatacgttctttcttatggtaattacagtattttacatctattgctaaagaaaattcaagccacagtagttatgatgagaaagtttgggaaggaaaaattcacctttaaatttccgtggagaagtaagcgtccttggcatgtaacggttaacttactctgtgcccctaggccctctttttcctcctctagatctgtcatcttagcctgtactggtctaactcagaacctctattgctcctcctgcttctcattcctccagctcctgaacagtactttgtaaattggatgtattcttttgtatctgacatagatggcatttaatgaataaatgatgaatgaatgaaacaaataggtgtggtgctattcgcacctcctgatctgacttctgatgccagtctgtcccattgttgatggctgacagtgtgcagtaaagaacacatggcaattcagaggaactaggtttgaatctcactctcccacttggagctttgtaaccttgggtacatggcctcatttccccaaacctcagcttctccttctgtaaaaacatttctaaagccacactgcaggattgttatgggaattagaattgtgtatatagatacgcatacatacacgtatcaagtgcctagcacagtgcctgacacatagtaatacacagtagctgctattattttcactggtggcatttttaagggtcttgactggtaatttgggtatcactttacatagctattgtctttgccagggaaagtctgactgtcattttccgacggacataagtctatgccacaatgaaagcctttttaaaacagccagatcaggaaaatgtggatctagttgtattttgtaactctgatgaattaaagcaggcacctactctaagtttacaatttgactcaaccaaggcctggcaagtagtaaacacttgataaattgttacttactatttttaaaactctcaagcgcccctaaaacttacgaaaagtgcattttgtgtgcctcacaagaaggtagtgaataggacaaattttgattttagggttgtttgttcttaatttcttttagttccagtttcatttctccctggcttcttactatgacattttcaataactcattcatgttaagttttacattccattttgatgttaccttctgctttgaaaccacctataaaacttgaagggcttaaactgcttcttttaaaatacaaattattaatgtagtaaactctgaagaagccctccaggagtgtgcctctgcataccccatgccaaactattgggataaataattttccctgtgctttgaggtaaggaaaatcttggagtttctaaagttttgtcattgtggaaactcagtctccaaatttatacttatgcaatccatatggtaattttggtccagcttttcctcagagtattacagtaaaattcttcttgaaaagtaagtgtatttattttgtattgagcaataattaagacatatttttccttcctctgttactagcaacattactctaagagtcttgtttttcaaaataccaactaaacaaatagattcctaccatttaaaacaagattttaaactcacagatctagtcatttgactgaagcccatgcagaatgacgggaaagctgagagcatgggctcggcgtgcacgtacgcccttactctctgccccagcttcatgctaggctgctctgttgctctgtgaaaatgttttgaaatggtacctccgtgtgtgtgtctgttgtatgtgttttctccccaaggagaccgtaagtcgcattatggcagtgacgactgcttctgttttctggaagcctccatagtgattagcacagtagtttgcgcgctctgtgtactccacactgcacgtagtggtgtctgtaaccccggggtttgtgaatggcacgtcccattttaaaacttaaaatgaactgccgattctgtgcatgttgtatagcttgtttttgaccatcaggcaagagaattaattccattttgcttttaattggcaccaggcagacattctggctgattttagttgaagctcacataaactttcgctatccttccttctgtattccccagtactctgagagcttattatagttatggggttgttttttgaaggaggtaaacggagctatttaaatatcttcggtacaactgtgatttttctttatcaaagtgaaggaagtgttctctctccccacgcgcttagatgaatcagcagtaaaacgttgcagtgcggtttgcagtgctatctaacacctggcctgggagagctggaaggattgggtgctggcagggagtgagcctctgccagccacagagtggagagaagtgtgtgctaggttttagcttccacctcttgcacactgaaaagaacaggatagagcatagaaccagggtctatgtggttttgcttctttcttttctgtcattgtcactttctgggttgtgaggcttgtggactgatgtctaacactgcccattgtgtatttgtgatttgcgttttgtaattaagaggaacaatgggagtccatggggtctcgttatatataatggttggtttaatttgtttcacttctatcttgttaattgtaaattgatcattaagatttgaattctaatctgtcaccagggttgtgagtattgaggctagagcaatgatcccggttttaatcactgatgatgagaaacaaattttataattttggtacatattgcagttcatatattttaacactatactttatggtgttataaatattgttaaatgacttttagtgtagttttactgtgtggactataatgtgtaaattatattactgttttggcaacagtaggtatccaactgtgtgagtttaattgaggtgaagaacacacacccggttgaactgtttttttcctttgcatgtttagatgatgttaggttgggatactataaaaattatattttctacaagaggagactgatattggcctctgctaattgttaccaaaagtcaaactagaacctaaaagaataaaaaattaagatattgtatttccctttgaaagcaattatcattttaatccgaattatagtagtaaaatatatttcatgcaaatgcaattatgcaacataactggtatataaaaatacaggggaaagttcatgcttctgtaaagccagaaattgcctgaattttctatgaaaatggattagagtcaattatccttttatatgacacaggataatcatgccagaaatgtatctcctaactaacagaaaacttgtaagtttactctttgagctttgcaaactactagttctaggaacatatcgtgagctgcagacagaaaaaggatgatgtgcaggcatatatgtcaaatttttattgaaaaatggaagttggtaggcaaattacaattataaacaaagaaaaaaacaaaaatgtgaagcagaaaaaaagattgttgcaatacacacttgatagtgatgtgtactttataaataacatttatatttttgggattatgtaagacatcctcaatgcagggaatttggaaaatacaaagaagaattaaggaaaatttcctgtgccactaccagctagagataactattcttacctctgatatatttcccttcagtcatttttcatgtgtatgtctgtgtacatttatagtgtgattgagattataccgtatatacagttttgcgtctgctttttcatttgatatctaatgaacatttttctatatcagtaaatactctgaaaacaaaactttattaaatgatttgcgtgtataagaattattaggcttttaagatgcttccaatttttaaccgtttatgaataataatacaacaaaaactttgtacctaaatctaaatttttgattgtttccttaattgctggtccaagacgattaatccttttaagggtgttgatgtgttttaccttgctgaagtactacactaacttctaataactgtatatgtagccatattagtaaataacattacaaagaagtgagatttttttaaaaaagcatgagaggcaatattgcacaggtgggtggaaccacccctttagaggtggactaagtaatatctgggcttgactacttggatgaccttaggcaaattattcaacttcatgtttacctcacagagaaaagaaaagaaacccttacaagtaccttataggattaattgagatcatgaatgtaaaggatggatttcactgtttgttatacggtggcatgcagtaaatatttggtggtagtatctggttttgttgtgctattttttgaataatagtgaaattgaatatgttataaatggtattgatcatttgtgtttcttctgtagatattttcaatatttcttatactttttaattggaattttgatggagagtgcagttagtgtttcattaaattatgcttttaatgtttgtcttatttttgtaaataatttcctgttgtttacattgattttaattaataagctttattttttagagcagttttaggttcacagcaaaactggacagaaagtacagaactcccatatattccctgttccttccacacacaacctcccccaccagtgacatctacattttgttttattatgatttttttcaaaatcagaatgaatttatttaaaacaaataaaatacatatctattttaaaaatttagaaagtatggaaaaggatgaatacagaacagagaaaacattcctgatcctaccatccagaaataaccaatattaatagttggtatgcatgtcaaaatatttttctaaattataaaatgaaatcacattacacatgctgacttttaatgttttctctttgttactaatatgtcacagttttagatcaataaatatcacttataaatagccacattatcagaataataagtaacataaccaagctcctgttgatagatttcttggttaagtttccagattatgggttgcaaagaaaggttgtttctagaaacaatgctacaatgaatactctcacacaaacctatgatatattttaaatgtgatttttttatgcataaaagttttgtatttttatattgtaaaatctatttttttctttgtgatttttctttttaaaagtgccttttgcttggaaagtgcctgggaaaagatcaatgttctgcatttttttctaatctggtttaaggattttttttcttcttttgaaatttattttagtgcatggtatgataggagatactaatcttggaagggataccagatcaaaaatttatcataactgcctctaaattcttttgtattgtatgtgattctgaaaggagaaacgtaagtcattattaactcctttcggactatttcaaatatgggtagattcttattaggagaagcaaatgtagattgagcacttgatctgaacttgaaaatgagataatccatgctctcatacagaatatggtaggaaagacaaggcacagagcacaatttaaaagaataaattataagctaatgtatgcataaaggctagaggtagcttcaaaaaacgtgctgacatattgagaactgcaaggtatcaatcagggcaagcttccttttggatgacatttgaaccaagatgaaaacaaaatgaagaatgaggtgaactaaaagcaagagtttttgctccatacacgtgagcagcctggtccttgggatgaacaatttgtaaagtaagatttcccttagcaaatccaaatccttttctgaccaggaagaaaaggctatcttgcctactggaagaattctttctttgaagggaattaattttatgtcaggagtcttcagaaaacaatccaatcattaacctgaaaacgactcataatatacaagagttttaaactttccattctaactgattaggcattagggcatgaggagatggtggcagtaggcagtaatttagagtttacttaatacaaggaaaggaatataatttttcttggataaacatctttctgatcttcaaattttgagacttggattgtcatctaagacacgaaaaacaagatattcccattttgctcaggggaggtcaatcttttttctattaagaccttcagtggattggataaagcctgcctgcatggacggcaatctgcttttctcaaagtttactaatttaaatgttaatatcatctaaaaagcaccctcacagaaatgtccagaataatgtctggccaaatgtctgggcaccatggcccaaagaagttgacacataaaattaaccattaaagaactatttttattttaactgtgtgccattaaactggttatgttaattaaaagaaactctgttatagaaattaggcctagggtttcttctttgacagcatagtgtttggcctataacaagcactcagtaagtatttgttaaatgaatgacagtcttttaaaaaagagatttgatcattatcatgtttgtcttattccttagggaagccatttctgttagagtaagttgttattcctttttctgtctaacacatgagtctctacaatgtatcttgccatttctgaaatattttcttttgcaaaggatgtagttttcattatgctatcatgtttaagtgtggagtttaagataatgttaaggttatataataacaatatgccctagtaataagaacttctaacatctattatttttgtgttttcacctctagatctgaaatagctcaactcagtcaagaaaaaaggtatacatatgataaattgggaaagttacagagaagaaatgaagaattggaggaacagtgtgtccagcatgggagagtacatgagacgatgaagcaaaggtaatcaaggtttcatgtcaactcatgtgccgcatattgaatgtgtttggtttacacactgaaggggaattgctgcggaataagtagaattcatcatcattatgctacttgtgacatgctcaaaatctaatactttattttatgtatttatgcttccttaatttaggttgttcttattatatacaaagaggagagtacatcctctttttgttattctctgaagacatagaattagatttaacatggaagaatggaggaaagccattttcctttaaggtgtaagttggtaatattgtaatatggaggaatttcaaattatctctcctagaaattagattttatatgctttttgtaaggtaaagcacatagtaggtctaaagaggttaaacatcttatcagaggttgcactaatagcattgctagagtcagaacttgactacaaacaaaaccttcacttctttctggtggtgttactttgagcaagtcacttaagttctctgagtgactgtttcttcacctatatattggcgctaatcatatctactttgcattttgatggaaagatcaaatataatatggcaaagcacatggctcataaaggccacccactaaatgtcatcaataattattattctctttttctagatgaagaaattcggctcagagaggctaataggtttgctcaaagtgacagatggaataagtggtagagttcagacttgaatcttgatcttttgactccaaaatccttttctttttgtgcagtaatggggattttttttttggcaataaacacagcctcttactattttttatccatgtgccatttctcacttctgtgtgataatggattccctgggcagaaaataatctcagtatttcacagcagacagtgaataggtttctgtagacttggacttccacatgacaaccgcatgcacgatgatagcagccacccttccagtggacacggttcgcgtggcctccagctcggcatccccacaccatttcccagccatccatgccttctctgtttcaaaaacagttcttgatataattgaaggaaatgaaaatatttatagactccttgtatttttttaaatgtaaagtaagcatattagcctggggtgggggggaggtatttttacgttgattacttgctttattgaatgaagacaggcagtcagatgatggcactgcttgtcagttatcaaaataccaaaatatggatatacttgcaaagtaataattattcattcactattaaaatgtttacttaagcccaggcacttctgtaggccaggggtctgcaaacgttttccgtaaagggccagagagtaaatatttcggactttgcaggccacacgtggtctccgtggcatagtcttccttgttttgtgttttttacaacccttggaaaaagtaaagaccattcttagctagaggaccaacaaaatgagccagaggatttggccattgggccagcctttgccccagtcctgtgcacctggggcatctttccatttattttcttacatttgtgtattgctttagagttcctagaatgctctcacacatagtaccttatgtaccttgaagcaaccttgaaagtagctgcatttatcatctccatttccagatggagaactaagcctaagaaagacaaacgtgccgaatgaaggtcaggtggcaaattaatggttcgttcattcaacattgattgattgattgattgattgctgctgtgtgtcacattttctaccacatgctggaataaaatagcaaagtagatatagttcccactctaatggagtatacatccttatagggaagatggatattagcaaaagaatttcataactgtctaattaattatagttgacccttaaacaacacagatttgaactgtttgggcccatttatacacagattcttctcaataaatttattggaaaattttttggagatttgcaacaatttgaaaaaacctgcagacaaaccatgtagcctagaaataatgaaaagaagttttaaatttaagtatgtcatgaatacataaaacatctgtagatactggtctttatcattgactaccataaaatatatgcaaatctattataaaaagttaaaatttatccaaacttacacacacaaacacagatcatacatggtaccatctgcaattgagagaaatgtcaaatgtgaaggtgcagtattagatcgtaactgcatgaagttaactgtagcacacactgtactaccgtgataattttgtaaccacctcctgttgctattgcgaggagctcaagtattgtaagtatccactgaaaacgctgtgtggactaaatcgtctgcatgtgaacagtttctctctccagtaaattgcttattgcaataacaagtgatctattgcagctcttgtgtatttttcatcatgtttagtgcaatacataaaccttgaataacaccgtgggacccatacgaagtgccactagtgatgttggaagtacttccaagaagcagagaaaagtcatgacgttacaagcaaaagttgcattgcaggatatgtagcttagattgaagtttgcagctgcagccgcctgtcatttcagatgattcatcttataaacagacattataaacttatggcatcaatatataacagtacagtactgtaaaagtattttctcttatgattttcttaatattttttctagcttactttattgtaagaatatagtgtataacacatataacatataaatatgtgttaatcaaccatttatgttatcaatataaggcttctggtcaacagtaggctgttggtagttgaatttgagaggagtcaaaagttatgcatggattttttgactgtacagggggttgatgctcctaacccccatgttgctcaagggccaactgtacagtaatgaccagttctatgaaggagaaatatattttgtggtacaagtacatttaataagggaacttgttttttaaaaaattatttttaagagaatatctcactctgtcgcccaggctgaagtgtaaccttgaactcctgggctcaagtgatcctccctcctcagccttccaagcaggtagggctacaggtacataccaccatgctctgctaattttttttttttttttttttttttgagacagagtctcactctgtcgcccagggtggagtgcagtagcgcgatctcggctcactgcaacctccgcctcctgggttcaaacaattctcctgcctcagcctccggagtagctgggattacaggcgcctgccaccacgcccaactagtttttgtattttttagtagagacagggtttccccatgttggccaggctggtctcaaactcctgacctgaggtgatccgcctacctcggcgtcctctgggattacaggcatgagccaccatgcctggcctaatttttaaaactttttgtgggtactaggtcttgctatgttgtccagtctggtcttgaattcctcgcctcaaaccatcctcccgcctcggccttccaaatctctgggattacaggtgtgtgagccactgtccccagcagggcacttaacattgattaagaaaagcttcaatgagaacatgacatttgaatcggtaagcagtgggattagatcaggaattggcaaactatctggccctctcctaaaaaattttactgactcctgttctagagaaagaaaatctataaaatggaagttcctgagataagaaagcatagtactggaggaagagcaagaactgtgtgtccaacataaaggaaaacagaaagtgtggcatacaatgaggttggagaggtaggaaagggctggacctaaaggcagggtctttatgtttttgtttttattttattttatttatttattttttgatacggagtctctctctgtcgcccaggctggagtgcagtggcgcaatcttggctcactgcaagctccgcctcccaggtccacgcagttctcctgcctcccgagtagctgggaccacaggcgcccaccaccacgcccggctaattttttgtatttttagtagagacggggtttcaccgtattggacagcatggtctggatctcctgacctcgtgatccgccagcctcggcctcccaaagtgctgggattacaggcgtgagctaccgcaccgggctggtctttatgtttttatcatggacctttaaatttatcttgttactaatgggaagaaatcaaaagattttttaaaaaatagaggagatgtgatcagatttgcatttaaaaattgtattctaactccacaatagataacagattggaacagagccatcgtgtttgctcaagaccagttatgggccgggcgtggtggctcacgcctgtaatcccagccctttgagaggccgaggtgtgtggatcatgaggtcaggagttcgagaccagcctggccaacatggtgaaaccccgtctctaccaaaaatacaaaaattagctgtgtgtggtggcgagcgcctgtaatcctagctactcgggagggtgaggcaggagaatcacttgaacccgggaggcggaggttgcagtgagccaagatggcaccactgcactcaagcctgggtgatagagcgagactttgtctaaaaaatcaaacaaacagaaaaacgattagggagtttttggacttagtcaagcaatgatgatgcttggactggaatgctaatattggtgacagaaataaacactggcgaaatgtgtaggaagtagaaccagcaggagttacttgattggcagtgctgggtggagaagaggagcgtgtcaaggacgacacccatatttctgacctgagcaatgggtgcctagtgctgctacttactgagaactagggaacactctaaagaagctggtttggggttgagatggcctgggtttgggatgagatcaagcgttacgttttggccatgaatttaatgttcaaatgatggtaaagatcattcaagttgtaaaaacgaagaaagttaaattttcaactggtggtttggaacccctggtgtccacaaaggcagtccagggaattcatgttaaagatggcagtgccattttttttttctgtttttattttaaagtaagtatcaattcacctatttctccctagaaaatagagctgtgtgaaaatcccccagtgtatacagagtggacaagccccagagccagtggagcactgctgagcacctgtgtcctctcatctgggcgttcactgtcaccgactcccagtaatcccgggggtttcgtcaattacacagttttacaggagttttttcccccttttgtatggtaatatattgtttaaagtatatccataaaaaccattgtctaaagacatgcagcttctgatcgaagtgtaacaatctagtaatgagtttaaaataggtaattcttctataaactagattcaggatgatctttaccaaatccgtaagttctatgtttgtcatagaaatttgattcttcaaaagccaatgttaaaaatacaaattataatattgatttctatctaatttgacattttaatttggggaattaacactatttactattttcagaaaagtgcttgaaaatagaagcctgaaatcttaatctttatctcataatttaaaaacaaaaagagtcctttgcaggaacatgaatggagctggaggctattattcttcaaactagtgcaggaacaaaaaaccagataccgtatgttctcattgtaagtgggagctaaatgatgagaacacatggatacttagaggggaacagaagacacaggggcctgcctgaggggaggaggtggaagaagggagaggatcaggacaaataactaatgggtactcggcttaatactagggtgacagttataatctcttcacaatctcccatgatacaagtttacctatataacatacctgcacgtatacccctgaacttaaaagttttaaaaaaatgggaaaattaaaaaaagagagaaagctgtaacagtagcagttgaattttatattcaaaaagcaaacatttcaaaacaaatcatgaaattgtttttatttgttattgattttataacatgggtttaatttcaaatctatgttttagagtatcttttggtgtgaagacgttattagccaatggtgcctttttctttcataattaattcactatggatttaatttatgtaaatgaaatagtggcattatttattgcacaggaaaattaaaattttatgttacaaagttcaaacttatgcttattttaaatgaaatgcttttacttaaaaagttcctctttattatatataataatgagatgatttaataaattccatgtgtttctatggagggggtttgagagtcaaaagaaatttggagacgctgaggtagacaaagtgcggcgtataaggttcctgagaagagaggtgggttgggataccaagcactgagcagaaaatgatagtgaactgggcgaagggtcacctcctccgttgccatcgcagcagctgtagcagaagagattatatgagctgataaatgcaggcttatggatacggtgctggaaaggtaacctgatgccagacttagtttattctgtgtttattgggcatctgttttgtaccagtcactgtgctaggcctggagacacaaagatgtaaaagatatactctgccttggagaactgcgtgaactcggagggcggaggttgcagtgagccgagatcgcgccactgcactccagcctgggcaacagagtgcaactccgtctcaaaagaaaaaaaaaaaaaaaaaaaggatatactctgccgcactctcgtggctgcagacttcctttctgtttgggctggcctaagtattgcaatcctgcagtgcagagtagccatggcagcacctgccatctcctgggaggtcactcctggctgctgccatgcctccagaaacccagatgcaagaagaaagtctctcctgaggaaccagcctcccttggcaggctagacaggagttggctgcccttaaagtgtttatttgtttaagtctcctgttctctctgttttatatagacctaaaggtctgttattgagatttggagtgtatggtcaaaaacttccactgcccctggggcagtcttgagttgttcatcctttgcttagaaaagtgatcaaggtgtagacccaagctccctgggtagtgatgaccagaagactcaccccgagtataggtgtttttgtcaattcttatggacagtttcaaaatctattaagtaaaaaatttaaaagtactaaaatttggtttttataagccaaaacaacttactgcgaatgctaatgcaatattctactggccgcctccacacccggcagagcttgtgtgatgtaacataagcgctgctagtttgacttttgatgatttggggaaaggattctaattattactaggttatcagcgttgttctgaggtcatcttcattttcaaatgctgctcttcttgcttttaattataaattgctgttaatttagcttcatcacaataatttagtttgttttggattgttttgttaaccccctacggtgcagtattgcatacttgcatcagtggtataatggtttcccagtaactacattttaagtcccgtatgacttgtaatacagaaatgaatcacccattatctcttttgctaaagcagatatatgatccctgcctcctgccaccacctcagcaatttgctgtagagaggcagtcctttgatttgctccttgcaaatgtttgtttttaagtaactgataacatgctattaagagcaaattaacaaaattagatttatatgccattattttataatataaaattatactcttatgaagaaatggtaagagatgtatatgttgctagaaaagaatcttattacatcttgttttgaaatgttccgttatccctagagtttgtttcactggaccactgacatgtttggattagggaggctgtctcatctaaggggtctaacaacagacaatcgaatactagaaatcacatagaaaagtttatccttttcaaattattcaaaaattgtaagccaattggggttcaaacagtccctttgtaatgagccagttgtatgcattgagaactccctgtgaggactggaagtcacgtttgtttatactgtggtgggaaggccagatcagactgctgccctcccaataagttgggagctttgccactctgtgggagttagaattttgatctgggaatggataatgagttatttaaagcaggctgtgcatttaccttagctgggacaaggcagctgctataactgattaccagggagaacattaagtgggaaaaggaggcaacaaaacaaagttgggacaatgccaaagaaatgatgttacacttttgcctgggataggcccactacccaggaaaaagaaaaagacaccctttgatttattcatcaaatatttaccgagtgcttatacactgctgatgtgcttgggatacatcaaaggacacgtagacagccttgtccttatggaacttacatgctttaagctaccttcaagatctagtcctttgtttttaagacctaaagccaaaagtagagagatagtatgcatcgtacgtaacagcatccttcctaaaaccaagttctctgggctttcctcagtttacttctttgtagctgctttgtagctccatgggctaattccttaatcttaaacttcatcttcctcactttcttgatctccaaaatgctaccttgtaggttgtgaaaactgcctaaaataatccacaaaaaggtctttagaatagttcctggcacaacgttagtgcttaacaaatgtttcacattgctattcattcatatccttcattcaacatatttattaggcccttaatacatgctgagctctgttctggattctgggattgcagcaggaacttcagagacttagattctaaatggttgtttatttatattataggttaaattgactcttgtgagttagtctgtgaaccaaaataccatgtttacataatgttatttctaaggcaaaatgccttttgaattttcaacaactgatttatggaacgacattttggaccacgacttgggatatgcctatgatgttctaagtgtttgtgaacatgtgaatgtgtgtgtgtgtgtgtgtcctctattcgatggtgaaaattttcagtatgagccccaagtaaaatttcaagagggatatatctatctagttgcttctttacaatcgtattttcagcatagttaggaataaggaacactctaaaaaatttttttatgcaagttttaggttcacagcaaaattgaaaggaaggtacaaagatttcccatataccccatacatgcatagcctcccgcattatcagtatccaccaccagagtggtataattgttacaattgataagccttcattgggacatcataatcacccaaaggccatagtttacattagggttcagccttagttttgtacattctgtggtttggacgaacacatgatatatctctaccattgaacatgctctgtatgatatcatatcatgtttatcaactttttttttttttttttgagcagtggcaaggttttttgtgaagagcaaaagaacaaagcttccacagcatggaaggggtcccgagcgggttgccccaactttttttcatgggtcgtacctttggtgttgtagctattgtcctacctgtggtcacctagatgttctcctatgttattttctataaattttatagtttcgtgttttacagttaaatctgtgatccatttcaagttacgttttgtgaagggtgtaaagtctctgtctagattcattctttttttgcatatggatatctagttgttttagcactatttgttaaaaactctatttttgctctattctactacttttgctgtttgtcaaagatcagttaactacattcatctgagaggaacactctttttaaattcctaattgtaacttcattaagtctttaggaacagaaaaacaaaaggctaacagagtttaacttctactcctgggagggaaaattttatattagtactaggaaataactaatgcctgtttggaggcaaaaattctgacaaaccatctataacctgccaattttaatatttttataatgtttattatttttgctttttctacaattaactgtggataatacaaaaatattcaattaataataattgctacacccatgttagcattgtacaaagaaccacaagaggctgtgagtattaaacacctatctgtggaaaggtcttttcgcaaaaagacagaataggtaaatttctgttcttatatcagaggggaaaaaaggtacatttcagtgctgaaagtccctgaaaaatttcttccatatatccaatgtaaacctctttcagtcaattcactctctaaagctgattttctctctttggtttatctttttggtagatccagaactgattagaattttcattatcttaactcttaagacttaaaatttaacttagaacttttaaattaaatctgatttttcatttctgtagttgtgtttgttgctttgccttagactctacaattttaaacattgaatattaaatgtgaaaacctagattgcctgtcttttgctttattttgcaccttctaacttattaatgtatccctgtatttattaacatgcattcagcactaggtacaaaaggaaaaaagacatgatatttcccctttagaagcttcgaatccagtgcgggaggtatacggtaatcatacaggtgtaatagactacggtaagagtaaacccaggatgctctctgtgtacatcagactggcatgtcacccaggtttggaggtacagggcacaattcttttgagaaataatatctatcgtcaaatcctaaaatgacatggaggaattcttttttttttttttttttgtattgaaacagagtctcgctctgtcgcccaggctggagtgcagtggtgccatctcggctgactgcaagccccacctcccgggttcacgccattctcctgcctcagcctcccgagtagctgggactacaggcacccgccaccaggcctggctaattttttttgtatttttagtagagacggggtttcaccgtgttagccaggatggtctcgatctcctgacctcgtgatccgcccgcctcggcctcccaaagtgctgggatgacaggcgtgagccaccgcgtccggccagaaagctgttttttaaacattaaccatcacaccactaatggattttgcttttgccctccctcagtgacagttcacatttttcctaggatcagggcaacaggtttccacccatttcccagaggaagacagcttttgcctctcaccttctcctggaggcagtgggcctttttcctgagaaggtttcttgcccctcccccgggagcttgaggcgtttgcttcatatgaaaaaatagtctagtcagtgggcagtggatgtcctcatgccccacctcggagggggaagctgctcgtgggtttttttgccccgccttcaatctttcctgtgcgcatccggggggaggaaggctgtggaaaagtgttcaataatgagtgcaggtttctcttgtcctcttgtgtttggggctcccatggattccaggctggcacactagcccacactttaagaacccattaaaaggttggctgctttccttttatctacttttacagtggccatttcccctttccttgctatgccaaagataaaacggttcaattgttctgccttcagagagtcatgtcaccttttggaatttacatcagctagttaccttgcaacctcagctctctgattggctcaagaaaaaatatgattttgaagattatctggcttttgcccattgttagagtgggagtgattgtgtgtgtgtgtgtgtgtgtgtgtgtgtctatgcacacgtgcgcgtgcacctgcctacctcctagtaggaggtagacccctcagaagttagacctggaggagtctttctcttgaaccatgtaaaaatgtttaggatttcttctgagcactctgagaggggcctttgaagggttttaaacaagggaaagacatttctgtgatgttagcgttttcagtaccatgaggcttttctcatacttggtgagccagagtggctcctgataactttctgctgatcatggcctatctttaactttgcagtttgtttctgatctctgagtttattgacattttcaccagtgattttgctcgcattatccaactacttccattcctatgacattcctctggtttgtatctttccatatctgttttaagatatgttaactaaccaagtgagtgacttcaatgaagatgctgccaattccttcattcctactgtcttagaacctgtgcaaggattaaatatgaatgtttattttggctgtagtccctgggcagtgagagtgagggaatggaaggtgaggcgtggaagaatggaaaacaatgtgtgataatgtgttacaatactggtgactgcttcttcttttatttttattttattttttattttttgagacagggtctcactctgtcacccaggctggggtgcagttgtgcagtcatggctcactgcagcctcaacctcctggatttaagtgatcctcccacctcagcctcccaggtagttgggacctcaggtgcatgccactgcacccagtttaccattttaaatttaatcatctggccggccgcagtggctcatgcctgtaatctcagcactttgggaggccaaggcaggtggatcacctgaggtcaggagttcaagaccagcctggccaacatggtaaaaccctgtctctactaaaaatacaaaaaattaaccaggtgggatggtgggtgcctgtaatcccatctactccagaggctgaggcaggagaaacgcttgaagccaggaggcggaggttgcagtgagccaagatcacgccactgcaccccagcctgggcaacaagagtgagactccatcacacacacacacacacacacacacacacacacacacacacacatcattggagctattctgtagagatagtagtattgccttctgtttctagagggggaaattgaggctctgagaagttatataacttacccaacatcacatagctaatatgtggcattgttagtctaggaatgcagggctatctgatgtcagagcccatgcttttaactacctgagtttccccagcaagccagcctctcagcggggcttggactacaagtgacagtgtttgttacatctaagtcaaattctctctctactaggggcctttcaggctaatgtgtcttagaaagcttcccaggttgtagcaagactaaatgagcttttaaaaagactttttaattgctaatggagcatatggtgcataatggttaatgatatgcagtttccggagctttctgcctgggttctagtgccagtcccaccactgaacctgctgttgaccttgtgcaagttacttcacccctgggtgagtcagtgtcttcattataggagagaaaaacggaaaaggtcccacctcatagggttatgaggcttaaatgagcttagcatttgcctggcgtgtacaaaacgacgtatgtttttgttaaataaaataagttcttcggttttattctgcaattcacacttaatagtatatcattattaaattaaaaaaaaaggaaaagaaaaacattaactagcaggtcttcctttaaaactaaataagctctgctgctagacaggaccctgcttttgtctcaggaaacactgaatttcaggctgcctttgagaggttttgttccaaggcagacccttttcacctgacttgggaagggcagttcactttgcctgtcggagagcctatgggtcagttccaggaagaattccaggaattctgggaaatggctggaaggcattgacatggggttggagctgtgtgtaaggccctgtaggcagcagtgttccaattgtgcacttttgatgttgcacaaaggattgaaatctagactcagtcaaacataatgaattaactgctttgtgggataccatggctttttgacatttctttggtaattttgaacaaaataacttctgaggtgattacataaggaaagcaatgcctttcgtgcttttgaagagtgttttcctttgttgagctgaatgtgtatatttaagggggaagagcagtttcgtgcattgttttggccgtgtgtagcatgcaggctgctggtgatgggaattgagcagattaaagtcaatgtttggttttgtgataatatcttgatgatctattcctggtgatattttctgggcttttgttttctagaaattaattggtttaaaaatggccattatccataaaagaatttattttgtatatgaacatgggccaaaccattttctccttcttatctatggaaaatagtcagctttaaggagccggtattttaaaggcattttgtatgaatatagaaaaacagcattaaagaggcttttgagtcactcttttccaacaaatgtaaattttaatatttatatgttaggcaaatgtgtcattaaaagaaagtaggcatccatctagctgatgtattgctgactctggctgctaagtgaagctcacacagtcctctgcaaatgtgggtacaggggatggatgggtattaagatgccaaacgtgctgttcatgctgaattgttttctaaccagcccatggtacttctctgctatttttttatctttttctttgtctgatactcccctcaattttacattactttcctgctctcttttcacggtcctgttgctttggttcttcatttctagaatactctcttcatttctagaaggaaatctgtggtcagaatttatgctcttctacagtaaaatggtaaatggtgtgcctaggagtagcattttcttcaaattcatatggctagattttattacctaaaatctgagatgtactaattagggaacaaagaattttaatcaaaaatctagttgtcagaaaactctaggtttgttaaaatatatatatgtaaatataggtacagatatatcatacagactttggagtatcttaacattgagattgttttatacaagtcagatcagcacataggaggagtcacaactgtcattgatcataatttatgaccctttctagactttctgaatgttgttatagaaagaaatgtcttatattgagcttgattctttaacatcatagaaattcattcagaaaagtttgatgaataacagaagaaatctttattcactggcccaaagcttagtttatattctgtgctgttataacatctatatgtgtgtctatattagtactatcagctctctgtggcaaaaagaggctctttaaagatggaaactattataataaaacttcgtatttttacaaaatacctcaaattggtagcattcaaaatgaattcatgttggttaataatgaggtgtacattttgctgtgtaagtgaatagatcatcatattaccccaagaggtgatttttacatctatatcaacagtgtttcttgagattgaggaattgtgaaaaggattttagtagaagggtggcaatttgcagcagatgtgtatctgcacctctggtatcactggttgtaattgaacaataaaaatgttgcaaccgtctgggtagcaagatggctaaggtcggctcttgcctgtgatagtaagaatggaggagatttgtttgacgtcatagactctggattataagaaggagacatgtcaagcagtaactacgtggcatgtggctgtgatgcgtctacagccaacctcctggtgtggccttcccaaagacaaggaagcgtcccattcaagtgtgtctcagtgcttgcatgacacagtgcctctggattttacgtcagttctgccttcagtgtaaagccctgattttcatagataacctaatctgtagggaaaaagaacattaaaaaaaaaaaagtatagccacaaaagttctttccactcatgtgtggatctttccagttttttcagacagaaaccaaatgacagcctcacagtcacagaatcttccaacactgaaagttaaagctgatttcttcttcatggagaaaagcttacaaaccttttcagactacttctttagtgtcaattcttggaaccacatcttcttcctgatttaaatgtttggctgtgtacctccagctagagctattagagtttttgctgatttgcttggcatatctccagcaaaatagtccattaaaattcaaatcctttcccaataattgagacaatcaatttacattaaacaaggcacaaatataattttatgtacaatttaaattctatagaaaataatcagtatgcaataaagagggacacttattttgatgcaaagagatgtttttctagtctgcattaaacaaatctttcatattttcaaaatagttccctcattatctttgtgtagaggagctctattgtgttttattttgatgtaggaacaagtgtgtgtccatggctgcatgtttgataagcagtgtaactttctctcagtgacatgtaaagggaaaggtttgagatagaataaggaaagtatttgcttgctatttaacttggaacaattcatacaaaaagggcgaagaagatgcatggggaatttattgcctttgtaccagtgttagtgaaatgggcattgtttgttcatcttcacctgtttatgatacaccaggtggttgttgctctgccagaggttgtgtgttaggtcctaggcaaatcactcaatgggacttgggaaggttgcataggatgggggccatgtgcacacacataattgtgtgccttagtgcagaagagttcctgggaaagttttaaagccccagcaggtaacctcgcaaggcagctagaccccaccagtgtgcctgaatcctccacagttctcatttgtaagctcttaatgagactggtattgtcggtcaggaaatctagaacactggagaaatattattaggaagaatatagtaaaaataatgacaagatcgaaaacaaatcctgtcagagcccaagaataaatttggcttccgcttgctgtgtctgtctgtttccataatggtccagaatagaaaccggatgtttaaaatctctctccttttcacatgctctcctcccctcctgtcttccttcctcttcagtattagtagacttactatttttattattttttatttatattcctagttttcaatatttgccatttgtgtggataacacattaatttttaatgaaatattttcagactcttggaactcttggaatagctgaatcataaaagaaaacttgaaattgatatagactccaaggcagcacacaaactgaaaattacgcttgtttttattcttcccactgacaaatgacaaatggttatttgaaaggatcatgtgtacttagatttaaacttcttatgtttctatatgagcctagtttgtataatttttgtggcacagaaggtaattcagacaccattttaattaataattaaaatgaaagaagcagcaaaacaatatgtgaggtagtgagctccagtaattttctttttatctagaaatacttatttttgacaagccacattgctagtaaaggaattcaagtgtgatttagattacgtcataggcttaactttattttagttctgttgcggcactaaagtttttttgtttgtttgtttgttttgtttttttttttgggatggagtctcgctctgttgcccaggctggagtgcggtggtgtgatcttggctcactgcaaccttcacctcccgggttcaagtgagtcttctacctcagccccctgagtagctgggactacaggcacatgctgccatgcccagctgattttttctattttagcagagatggggtttcaccatgttgcccaggctggtctcaggctggtctcaaactcctgagctcaggcagtccgcctgcctcagcctcccaaaatgctaggattacaggcgtgagccactgcgcctggccagatctaaagatctgaaagaaagtggcatttgtttctttgggtaatttatttccaccaatcaataattgttgttagtgaaattaaagttaatactgaatattatttaattttatactgcatggtattctcagaaatgcaactttgtaatccactttggaactgtaaattaataagaatagtttcttctaaaagtttgttttttgttatagatagcatggacatttaagatataacatcttttagatcttttcttattctcaaattataaggatatcaatttctattttatgttggcaacttaaatcttattttaatcatttatatatgtggttacttttatattttcttcttttaaattaaaattcctaaaaaagtctacttatctcaagtaaatttacttattctcacattaataacaaacatatttttccaaatattattttctaatgtatttctaaagactaataaatttttaaggagctctgcctgtcttatatgacccgagttatgtagaatggcattttatagaatcagaagaggcctgaaagattatctagtccaacttcacctcttgtcgtctactcccaccctccattcccatccccatccccagcaccacattttatagataagaaaacggaagcccaaagaatacaagtaatgactcgaatccgttttctgacatcaggtctagtgttttctactgtacccactcaataacttatatgcttccagaaatagggaggtggactagtactaatgatgaaaaggaaaatatacaatggacataaataatcagatgtttaccagaagctattttgtccagtgaccttgagaccagaagttggatggttaattggaaggtcaaaaaatacatgacaggtgatggatatgtggggctgaggcatattttttgtgtgtaaggatcacctgatttggcatgccatgtcatttgccctggataaacaacacccaaaatacatcttttattgcacccaattttgatttctccaaactaagtgaggacataaagacacttgggaaacagccttcatgcagaatttgctattttaatggcccttgcccaccaaatcttttacatttatttcaggcacacctaattggacaaactttttgtgttggggggtggaaattcagctttgttgaatgcttctaaatcactccactgcgttttcatagaatcagcaactctttttttaacaatcatacttctgaattcagcaaacatggaattacgtttatgtaagcagcacacacaggcttgggaagaaacatggctgactttaggaagtagagcacaactgttgggagcacaagcgcccatttgtgctggtgagtagcagtcattggccatagcactgagtgtgccgtggacatcattcatgtgtttgacagagggaaaaggaaagggttagttgttgggtgatcagggtaagtggtgctccatttagagagcttctactgtactttggaaggaactacctgagtcagacaagtaaagatgtataacataataactggttaagaagaatgtgcattgcattctccatgcactatctttcctccttctttttttaagacagggtctcactgtctttcttgcccaggctagagtgcagtggcactatcactgcttactgtagcctcaacatcctgggataaattgatccttccacctcagcctcccgagtagctgggactacaggcatgcaccaccatgccggctaatttttgtatgttttatagacacaaggtctcactttgttgcccaggctggtctcgaactcctgggctcaagccatctgcccaccttggcctcccattgggattataggcatgagccactgcacctgaccaatttttttctttgtgtcagagaaaggccaacttggaggcagaagaaagggaactttatctgtttcctttctgctttctctgttcctggcttaagaacatcagcctcaccccacccagaagctgggccagtggagcttttatatactgagcaaaccatccatagctacttggcaataaaagcatcggccactgttcagcctggagaatatacctcatgtacaggttttcaggtgacctgctgcccagttggggctgcttggggctgcagccaggctttctcggatggggacctgattgactccttgcataaaagtcatggaaggactactttcttaggagactgtatggctgaaaatacaaatagcttcaaatgggtttaggaaactcttggattaagaacccatgcttggccgggcacggtgtctcacgcctgtaatcccagcactttgggaggctgaggcgggcagatcacctgagttcaggagttcaagaccagcctggccaacatggcgaacccctgtctctactaaaaatacaaaaattagccaggcacagtggccgtgtctgtaatcccagctactccagaggctgacaggagagtcacttgaattcaggaggcagaggttgcagtgagccgagatcgcgccacggcactccagcctgggtgacagaacaagacttcgtctcaaaaaaaaaaaaaaaaaaaaaaaaaaaaccatgcctcattcttaaaaggcattatgaatgtattaagtctcatcgctaaatgaggaatgaacaaatcaataggtaatgaacaactattctctctctaaattgggtgaatataatccttccacttttccttttattttgggggaggaaggggatctgagcatccattctatttttcttccttaattaggtcttagtatctatcaagatggtgattatagtgtgtgtgtgcctgcgcacgcacacacacactatcttacataactgcctgtttactcctttgctacactgtgactcaaaggggtggggcagcacttttgcaaatgtgttttacagacaatccgtccttcacagatagtctttgaaaaaaaggtttgcatgatatcttagttttggaacatactgcataaactatgtactttttagagagtcagaatgtacattaggatattaaaagcattgataagtcttcagaattattaaccatttttaaaatttaagttatagttcaaataatataaataaaaatatttgtaaacatttaaaactttacaaagaagggtaaggggatatggtgtgaagagctacaaacttccctgtggggtggttcttggagacatgtcaccaaactaagcatgtaaatggcttcctgtggcatttcttagaggagctaaatagtttctgcgtggctttgtgatcatctttcacccttcctgtcccaaccgtggcttttattttggctttatttcccttatagcatagtgtgcagcaggattcccgagtccttgcttcctaactcatgggttgggagagctgctcatggctgtagctgctgcaggcacccgcattgctgaacaatgggaggtgtcatccacaggtgaagcttgaggtgtggttcatccaggcttctgggaccttgtcaaggcatagatttagacagaaacaggtcctccagggcttggttatgtccattactaaatctggctgtagcaaacaaggagagtaaacatcttttctttatagttcatgagctctgaaaagggattttctgttgttccgttcttctcaggaatctagaatcaagtgtgaataaaagtagagaggtggttggtgtttgttcatgtatttattttatttatagttctttcactctacatacatacattcttcagatatgtattgtgttctaacaatggtaacaggggcctgtggtaggctttggggttgaaaagatgtgtaagacttaacccttgtctctcagaattcacagtccgggtgctcgtgcctgaaagaccttttcctcccctgcctagagacctcttatttcccaagacacaggtcagccatcatctccagtacaggcttccttaatgccactctctgtgttactcagcacttcgttcagacagcagtttgctcaaatgtacaggacattataattattctttgactgtccaacttgtttagactgtgactccttaaggacagaaaccatactctggtcatctttgtatctcttgcctatagttcagatcctggcccttagaaggcatttactaaatgaatttgtagtcctttttatcttctttttaaaaatcatcatattttatcatcctttttatctcctaaaattgtagaagggtaaaaatgagacaaaagcagaacttgatgtgtatgtgcaacatttaaaaaatattttataacctctcatgtatatcttcatgtttggaaaacctactcactatatgtgtgtctaattactattatgaagtaataaaaatctatagttttattgtataatgatgcacatccagtggacactcagtaagtgttaatcacactattaaatatgctttgatctcattataactggagtggctgcctggctctacttaggctatttaacaactcattgtgttattagttgatccttatttttcaaggtttgtaggtcatgcttaatggagcgacttgctaaggttgttagcagttacataaatgactctgactttacaaattttatgataaccatttggaatgaattatatattttccaagcttttggttcccccagtggctgatacattaaagaataattggtaagttgcaaaatttgtgacagttttgtttttaaaaaatcagctaaatttggctttttacatattgctagtgatttctgtatcatagatgaaggagatagcatagacttgaggctgggaaacacgtttcttctttcacatagccaggcagaacagcccttggaagacgatccttggaaacacattatcatttcttgttcaaaccaaatatacttaacttctgtatctcttccactttaaaatcattatttttgtgaccgacgtctggaagtgccccagtttttccacatggcccttaacacatagtgttagtgttgcatttcgtagttctcattttgaattatgcctctgtgttcactagcagggttacctcctgttaggcccgactggaccatggagtcctgggctccttttggccttttgcctagagtagggaggcctcagtgactgcaaatgtggcaactcgggcagtcccttggccctttccccttaggtccacactcccatcttgggattctgtcttttccacttcaataaatggctccaaggaagagcttgaaaacgtatttggatctgattgccaaatttctcaccagaactattctttcagggtgggatttttgaggttgggtaggggcagggttaaaaacatgagctttctctagaggccaacattccctgattctaggcagttagtcagaccttgttcctatggtagacgtctctgttttccagcacttagagcactgtattcatggccttcgatgtccttctctcctcattagattgtgaggtcttcaatgtgaaccatgtgttatcaatctctgaagtcccagtgtatggaagtgtattgaattaatgaatgattctctaggaactgacattgttttcatttaaaagttgttaggtaatggttaggattaatataggctgattccatatgtgtcctcagttctttccaccacaccattagggtttgaactcccctggcttcattagctattttgcaactcctttaagctgctgtatagtttggttcatttgaaacagaaaaccagcgaaaaatacaaaggtgattgaatacctattacatgataggaattctgcagaccttggagatatggaagataaatcaatcactgacttccagggattcttgtctcgtgggaaagcatgtattctagcgttgctagcccctgttttagtagagatatgagtggacagcatagggtatgtataacctgtttatttttgtttgtttgttttgttatataacctggttttgtttgtttgtttgttttgagacagagtcttgctctgttgcccaggctgggagtacagtggtgccatctcagctcactgcaacctctgcctctcgggttcaagcaattctgctgcctcagcctcccaagtagctgggattataggtgtgcgccaccacgcccggctaatatttgtatttttagtagagacggggtttcaccatgttggccaggctggtcttgaactcctgacctcaggtgatccttccgcctcggcctcccaaaatcctgggattacaggcgttaggattaatatagcatttaattctaaaatgctgctaaaatcacttgttgaaaaagaagtgtttattgatatgacaaaatgttcaaaatatatcccctaaggggaaatagggtaaaagtagtatacattatttcatcttttgcatacacagaaggtatatagttatagatctatagatggatatgtactgcaaatgtcacatcttcttcatactctagcttgtgtatctcacacatgtagactcaaattttgccccatgtcagtttgtacatagagctcagcatctccttgagtttccctaaagatttcataggcacaaatgtactgctgatcagcatggattttactgaagatattgtaagatggaaaacattcatgccatacctcccttagaaacaacataacaatctccattaatacttagttctcccctccataatcctttcctgggtgcattcccaacttggaacttttttttgtcctatctcccgctttccttaaccctataactttctaattctttgccttctcatatttctaggagccaaacattcttcacccccttctattatgcagaaccatccagttctgccacaactcttgtcttaaatggacatattcagagtagcctgcttcttgagtaagcacacattgtacacacatgcatacagacacttacgtatatatactaaaggaaatttaagccaggcccgatggctcatgcctgtaatcccagcactttggaggccaagttgggtggctcacttgagctcacaagttcgagatcagcctagacaacatagagaaaccccgtctctacaaaaaaagaaatacaaaaaccagccaggcttggtggtgcgtgcctgtaatcccagctactcagaaggctgaggtgggaggatcgtttgagcccaggaggcagaggttgccgtgagctgagatcacgccactgcactccagcctgggcagtagagccagactttgtctcaaaaaataaaataaaaagttgattgcggcctgctaaagtaattttgtgacccactaaagggtcatgacccacagttaaaaaacccttccatcaaaggccctttgacaaccacacagctgctgaataaaattgtgtccctcttgttacatctcgttacacctgcgtgtgcatgctcaggcgtttccatgtgtgtgcacacacagacagacagtaggccacacaccagaaaggaatatagtagtgctctctgggattactggtgtgccttcttccactgcactttctggccatttctaagttttctgcactaagcatgtgttagttgtgtaaaaggaaatgcaaacagtaacaggctcagctggggtttttcgtcttcccctttttgttacctcccctagtaacccttgcaaacagagttagactcctctatctctttctctgtcatacctttttgacttctccctacccttgagatgatctcatctcttttttttttttttttttttttttttgggacagtatctggctctgttacccaagctggagtgcagtggtgcagtcacagcttactgcagcctcgaactcctggcctgtagggatcctcctccctcagctttttgagtagctgagactgttaagtgtgcactatcacacctggctatatatatatgtatatattttagaaatggggtcccactgtgttgcccaggttggttttgaactcctagactcaagtgatcctcctgcctcacccttccaaagtgctgggattataggtgtgaaccaccgtgcccagcctgcaatgagattcttacactgaaatgcatagatgggctgtgaaccttcataaaatttatataaaacttaatgtttacttatttcttttctgagaagcagatccaattattctgtgagggcttctgttgtgccaggcaaggttctaggtctgatcctttagcagcctctcaaaacgttgaagaactgagtgactcttcttactctgttgttttccttctctgaactgtgagtgccacgaggcaaggacttcatccgtcttgttcatcactgatttcctgctgcctagaacagtgcctggaacatagtaggcactcaaaaagtgtagtgttctgaatgattaggcattgtgaagtagaaaatacatttatcttatgactctccttttccggagttgatgagatatcatgatgttattggagggtgcaggaggtgatcaacagtattctaggactttgggaattcagactggggatcacaaaatttggagcaggtttcgcttggcactcaggtgggcatctgtctccatcccaccggctgtactctgcagtggctggtaaattacactcttcttggtgggcttgaggccccagcccaagactgcagggtcaatgcaacataaaagtccaggtctcctgactcggagtacagactatggcagcactcctgagcttgactttccctgggcttcatttaatatggttcattttgtttttgaaggtagtttgtgccatagaaaccagacagggtgttgtttaaatagtaggctgatgtctcaatgtaacatattggcccactgagctctacaagagtgtgaatcacaaacccgcctctgtacatttctgatacagtgtgaatgttctggatgtaagaaaatcctgttaagaatgatcaggttatctcattttgccatcaatcgtattttgaaatgttcggttgatagaataactgctcttcctggctaaatagattctctcaactccagcaaaatatttttaaaatcaggtaattcagccagtaatccaaattttatttggtttattttcttcagactgtatatataataccaggactgagtgtttaaagttcagctcagtgtgtagtattcctgtgataatttcagcacataaaataagatgtttacaaaagccaacctgagacctatattctccagcagtttagcagcaaattcctactctgggtatataacaataattgggatctttctattggctttacataaactcagattagtagtaaaatctaagtaccatcccatttggcaaactcttaacttcaagcagtcacaaatttgcttctgattgtgcttttcattcgcacctagctcagatttttgcctgatgcttttttaaatcctctaatttacatactgtggtaaatttaaaatgagaacagatgaatgctgctaaacttttctatttcactgatgaatatggtattttgctttaactatctagctgttatatattcaatgacctttaaaacatgaaaaagatacttcttttcatatataccgtgcaagatgaattattagtattgtcttcctttgaaactatgaaactgagacacagaggccaagcagagcatctgggaactgatttccacaggcctaaaatcagagtttcctcttcccgggactcataccccttcagccaggcagagaggcctggttcgctcacgtttggttatcttggaactgtgggaggtaatgcatccactcggaatgcacttctttccttaccccacagcccccgtgcaccacagcctacatcactgtacccgtttgggcatgtcggaacaagcacgagtaagggaagaggtcgccgtttttgagtggctaataggaatctgctccagctaagcatatgttatctcacatattgtggttaataataataataaccgtgttctccaaaggagccaaaggagagttggagaagttacattattcaacaactgagatgtctaaagcctgtgctcctgtactatcttctgtttgtccctgttatcttgtttagtgagcagcatagcattttgcaagagtggaccgttcacctggtcaggatttcagtcagcatgacagatgcaccctccactgtggtcggtgtctggggtaaccagagaaaacttcccagatacggtagaaataaacttcccagatacggtgggaataagcttcccagatacggtggaaataaactgcttgacaaaatgaatagatccaccatgacgtaattttctaactgttcatttgttttcaataaccaaaagcaatattaattttgaaattatatacactacttatgattaaaatgctgtaattcataagacaaggaaaatctagggcacattttaaaagaaaagtttaattttgaaaggaggaaatctatttcagaatgaagaaatgaaaacttttgaaagctttaacaaaaaattcctagggaattttgaagttttattttgccctaacatgaaaaagtaggccagttgctaaacgttaattgctttacttccatctatctttatttttgtttttattttttgagatggaatctcgctgtgttgcccaggctagggtgcagtggtgctatgtcagctcactgcaacctccatctcctgggttcaagcaattctcctgcctcagcctcccaagtagctgggattacaggtgtcggctaccatgcccaactaatttttgtatttttaatagagttgggtttcaccatgttggccaggctggtctcgatctcctcaccccaagtgatctgcctgccttggcctcccaaagtgcagggattacaggcgagagccaccgcacctagcctatttccatctatcttgatcacacttgatcatgttgagagactagaggctctgaaatttaataaatgacctaattcaaaatatcttactccaaatccagcttgatagaaagccaaactgttgtcagtatatctcactttaagcaaacccaacatattaaatccatatttacaaaatggattagttaagtagtcattcttcacttagcaacataattcattatagtaagttccccttgtaatgcatataaacgtgatttactttattagaaccctctgtgtgtgccacatttcaagtgcaaagtacatttgataatgttactcaacaaattattttctcatttgtccaaatatttggttgggcatcgctgtggcccctaaggaaacaaacaagtgggtcagaatggcctctggaccgaagggatgcgtgttgcaggagcaaggactgttggcgtgggctgatcgctggtctacaggctgtgggagctcagagcatggacccagtcagttcagtctccatcatcctagttttctggatcttccaactccttattcatcgaatgaaccgggagcatgcagaatttatcttggtggaaagcctttctcctcagttttctctccctgttttggtttactgaacaggaaagcctgacataattaggtctgagaagagtcatcgggttctgctctcatccttgagcctgccctggttggtagggaaattcacttattaattctgtggctggctttgggtcatgcagatgacccagggtcactgggcttttcaggttatcaaaagctaaatgacgtgggacacttctggggattagtttaacgaagctgtacaaatatagtcagatgacaaatttggagatgtagtggcagagtaaatagtatttttaaaaaatgcatgcctctgaatgtaatagtaaacctgtatgagaggctctgcttagagagaaattagagtgagctattagctgtgcctatatgtttattttcatataaatacatcaagaaagctagattttttgcttttatttttataccaatatgcctaggttaaagtgggtcattcccagcatttaaaaagggggtagagggagggcaattggcttggttttggtaaaggggtaggggattattttttattttattgtatttagggggcaatcttccatctttatctcttcgttcttgtgcttttcctggaccatgtattctgatcatatttaactttctattgtagaattgggatggaagacctagagttcagcttgaaaatcttttggtagatgctatatctttaataaatgttaaatacaggcatcacacttttaaagaacatttgtttttaagggtctttgtgcattcatctgaggaaaaagcaaccaaatctgttttattcaaattccaaattctaggggagcagattgtcacagaatatacagtgatgaacttccaaaaaggaaaatgggcggaagactcgtaggtatttatcacgcatgctagaaacattaatgctttctgaggaatcaacagatctttgattctcttttggttgagtgcaccttattttgtaaaaaaataatttattgattatttcatatttttttctttaaggaaaaatcttataaatattcatattcagaatagcatgtgtctattctgttgatcctgaagccataaaagaagtttcattctcagtgtcatgtcaacaatgaaaattatcacaaaaccaaaaataattcatgtaaatgtccgcattgtttaatcatcggttttagatccaaagcatcattctttctgtttaaagtggtcattcagaaccgaatattttaaatgacttataggagccctgtagaaaatgtacagaaagaattcaccgtttaagtaaaaatatatttgctttgcttggcctgtcagtttccatatttgcagtggcttcccattattgactagcatcatgcattgaggattaggttgtcaaatgcggtgtatttacttttgaacttctctgctggtaacagtcggtgcatacgtgacatttgtaatgctgatggttgatttcaaagtatagtatctaagtccaatttttcatgcattttatgaagcttttgtccttaacactttgatttaagtcgctcaaaattcattcttaaaagagagatcatttcgatgtttacataattgcaacctcaagcgtactttgcaaatttcagctggcactctccaatccctctgttaagtggttatcaagggtggttattaccatttacaatatgaggaaaccaggagacagggattttattgacttatactgtgaggcagcattgctgctagtctgttaatatgtgttttcgtctcttttctaaacagattttaaaatttggctataatatgttaggcatcactctctggcagaaatataattgtcaggtgtgctggtatggatagaggtcctgcagaaaccttcaggacccatcccaaaatgacgaagacacaagatacagttctgtcctcatcttgacttttgtgtgggtcagagtgagttactaattttagaagtgttctcgtgaagacatctgactactcagcacacacaatcttaaggtctttgctgtaagaagctcaaccatcctttagcctccctggccagggaccctggcctctgcttttgtgtttcaagaattcttggttctggccctgtccttgattccctaatttccacagtttgacagcaccgaatgttgtgttaagcttcttgctaccatgtaaaaatttcctgacacctcttgcaataataattgttattatataatatataattatgtaagatataataaatatataataatcgtcattgtaattctcatcactgtagtagcagcagctaactttagagcgtgcttgctatgtaccagctcctcttctaagcacttaccttttaaacccactgaattttcataaccaccacatgaagcgagtactagcaatatccccattttaacaatgaggaaactgaggcacagtgaggttgagtaacaggctgaaggtcacacagctactatgtgatagatgccaaacgtgaacctgggcagtgtggctgccaattctgggaagaagggatgctgatttgaagaatcttagcaatattttagctcccataatagtaaaaatttttagaagcgcttcctgtgattccagtcagatatggcattgttttatattcccattgtcagtgatctctaaacggcattcctgccactaaactgccactgttttcctacaagggacgtctgatcagtttctgaattgagtcccaagatacgtgccttaagctattgcatgaatatctctatgtgggaaattcttgtgttctgatagatggagaaaaatgtggtggagatagtaaaatattaccagtttcaaatgtgtttatgttaccttaaatttgaggcagactatggagagtgagaagaaaaagcagaggggcaataatctgaaataaaagagtgacagaaaggacaatttggtaaagcctttccttcccataatgaaaaaagtagtccctagttattgacaattcactcagacattactgtactttacaatagtctttacaatagtctttcaaggtttcttccaatttatgattgaggaagtggaggctcggagggaggaagtgtggccacagctgcacagtcctaggagggaaagctagaatttaaataggtttgcctgactcgaaagcttgtgctctcactgaaagttcatagtatctttctgcctctaaagagaagatggtcctgttgaacctggaaaatcagtggctaacatggggcttttcaagactcaataaggtggaggaggccagaggttcagcacgttctgccagaaacaagtcactgaagaacggaggtgtattacagaaaggcttggggggtggggggtggaaataattgtacctaaaatgaaagaaaacacaaccttttggaagagtgggaatggaaggtgatactaaaatatttagaaagctaataagtttttgttttttaagagacagggtttaactctgttgtgcaggttggagtgcagtggcacaatcatagctcgtggcagccttaactcctgtgctgaagtgatcctcccacgtcagcctcttgagtagctgggactacaggcgtaccaacaccctcagctgatatttttattttttctggtgatgaggtctcactacattgcccaggctggtcttgaactcctggcctcaagtgatcctcctgcccaggcctcgagaagctagtaagtttctaatcagtttgcacgtgcttctgagtatgctaatgcttttttttattaccactcaatggtaataaatggtgacgtggtaattccaagctgtttaggaaaatttgtactaccaaatgtcactgtcactcaagggattattgcatataggtcttattttgtttgttcttttttaaggctttctctgcctttctcccttctgttaccatggcaatattaatgttattgatctgagtggaacatgatgttattcaccagtgtgacatacattagatttgtaaagaatctatttattagaacaatttatcaggtgttaataatgctcatacattatattattttttggtcacccaatatagaagcctctattgagataaagaggcatgattttttttttcacaaaatggatgatttcttattttaaacacaaagtgtgtgtagcgagcactactttctctaggaggatctccgggaggattctggtggcatgttggtcagccttccctgaggcgacccgcaggaatggaattggcgccagcagggaacagtcactcacagtccacccaactcacagtgtgactgatcaccacgccagtcatgtcaaaactggacatttcctgttcacagaaagttgaagcaggtccattttgaagaacatctgattggacatttaaaaatggataaagatgattcagaggaccaaaagcccaattttccattttcacaagctataggtagagcagccctagctgactggaacaaagtgtgactgaagcatgtttattgtgaagaaagagatggaaatactggagatgggcattgacttaactctatttcggtaatgttgtggccacaccaataagtccccagcttccctctcccctgtgtagctttttctcctttttctgtttgttgcacccctgacggcagcgtgttcggcttgttccctttctcaggtggtggaagtctgtggcctcttagcctgtgcctcccagcacacctgaagaaaaccacaattcccagtgaggcactgacgcttgtatcttattgcttaattattatacctatttaatgctacttagaacattgtcagctgttgag[450 bp omitted]gtagcatctgaagtctttgctttaattccgcagcatggttttgaggagttaccagttccttgtaactgtatctgtggcatgactttcagagtctttaagaggcttcagaagtccattttcttcatcttcaaaaaatttgcactgatgagagatgttttctctttcttggcacagtcagacagagctgagctacatgaccattctgctgagttctgacatttatttcattggaacctttgttaccactgaggcagtctgtttcattttcatcccattccttatttctggactattggtgcgtctaaatgtaccatggtacatttttaaaactcaatactatacagagctttagcgtcaagggaggtgttttcttggatgaattcctcttctcaattctaagaagattcacctccacctggcccacagccctcacacacatatttactgcttgttcccatgtgcaaaggtcttttccgagcccaaatgggtcatgacctcttcgaggggaagggctaatacctaatatattttggtagccactgtgatcagagctcataagaggtacttggacttcaggtaagtgaaacacaacatctttggaatgagatcttatcccattggttctttactctaagatttcactttaccttaccctctctccaccacttctcaaccctgcatcagtgtagcacagagggaatgaagggggctgcaggaaaggtttggaggccaggccgaggattgagcccactactttctgcccttccccatttgccagaactcaagtcacctggctcaaccaactgcaggagctgggatgcatgatctagaagaggaggaacctgtggagtggtgagctccagtgttctcgttcctatcatccctgcctctaaaaataaccctccataaacaaatgatagcaaaagtcatctcgtgcatataaagacatgacagaaagcaatatctttttaggtaaggggctgtgtggctgtgaaggtaaggacagtaaccagtgaggtttccctcctaacactgtcatacacacatccttttcacaaatgtcatcttgctaacaactatgcaacctccttggagtgaaatcttggctgtcttgttctccactgtatcccaacgcccagtaaagaagacattgtaggtgctcagaaaatatttgctgagcaaaaatgaatgcatgaatagtagaacaaatttacattgtatttttttcacattatcttaaaactcctaccttttgtacagccagaagacaccagcacctatgtgtgcactgcatttaaacagctttagcaatatcatagtgctgttgggtccccagctgctgccagtgaaattgtttacctagaaagtccccaaggccttttctgcaccaagatatttgccttctctcatcttttggcaaaaaacaaaacaaaacaaaacaaaaaaaaaccctaggctctttggaagacaaaaaaagtatatgactgccacacatgcaaccaactctctgcttccaccaaaggtggaaatggttttgtcagtggttctctgaaagctgtttattttaaaagataaataaatctttccccttaccctgtgacatctgatccagggccaataggagctttcaaaacacagtcaagtccactgatgctgttcttaaaaatgcattctttcattcaacagctgcatgtattggacactgtgctggatgctatgggtaccagcaggattcagtcctgactctcaaggagctaacattttagtgcaggaggcagacagtcatagtgcactgtggtaagagccatgggtagggcacagaagaaggaacaggtaagcatgagaaggccaagaggagctctgtagagtggcaacacttgatggctagggagaggcagtgtatgcagaggagaataaggccctttctcttctaatatttttttggattgcacactttagaaaacaattttagacttaagacccaaaatgagaagaagcacatgacttctggctgacagccctgacatccccaatatgaggacatgattctgtgccttgctggacctcctgactgcccagccagccagggctgctcctgtgtctgtccagccccaagaccagcctgatggaaaccgcttcctgtaatgcctaatatagcacagtccactcacaatatgggtctaaaaccagacttttatcttgggagggaaaaaataatatatgtaacaaaaatgtaatccatggtaatattactcattaaattcaccatatgattaggtttttgagtttttagtaatccactgacatcttctccctgtctttgtgatgagtccagagcctgcacctttgactctgtttgcctgggtggtactccgacatcttcgatagggagggtaatgagaccgttctgccagtagggcacatggccacatagactgtttaaatcatgaaatctcttggaaatacccatccaagggatggatgtgaactctcggtgttcccgtgagagccagcaggggtaggtgccattggctagagagacggctgaaaataacccttcattcagagccttgtgtagaaagttgggttgctgtgctcatgtcctcttgacccaaaattgttaacatggttggatgaaatgctgttcctagaggggaacaaaagtggctatcacaattaacatggccctgtttgacacctgatcctaaaagtgatttttgtaaattagagtttgaagcatgtggtggcattggtggtgctttttctgaatgttgttcacttaggttttccagttacacgaattgttttcggggagcttacacacctgttcccatcctctggggtgggctagttgctatgttatgaaccttaacctttgcatatacctctgttttattcatgggaggtcacaacttggtaattctgtctagtattcaagcagattattacaagtgcttagaagactaatatagttagcatttgatttgaaagggacaaagaccagttaatagttttctgtaactatacttaatatttcatcaggcaagtaaggttgctgccacttagttaactgggatgccaaggaattgctaaaaaaaatcaaattaatacacattattacacatatttacacacattgaactatttcaaaccagtattgctggaataaagacaaaataatactgtgtatttacataacaccataacacctttcatcagaaaaatctcaagccttcgcagactaactaagctgcacaacaccgtgtgaggtgtgtaggaagtaagataggacaataaacaagaagtcgatggagggaaaaggcaggcaggcaggcaagcatgcttgcatagggtgagtgagactccttcctgctggatgacccactggcattcaagtcctggtcaccccatcgtgaggatacctagattgaaagctccagtacatgtcacaggtgattacagacttgagtattcttctgtgtgttgtttttccattctaatgtctgtattttaattgaatcgactggacaaagatacagcattccacctctactggactgtaacagtgactcccagtgtgatcaatcatttgatcattgtttcactttccctagggccaactaaatacagtttcctttatttttccttagctagaatttttttactaaagtgtgacagtttattctctagaaatgcctagagatggctgggtacatgctagtccatggaaaaggcatgggtgagtcatggtctcttttgggagggtcggggctggtgggaacaaattcctgcccaagcctgcttcagtggctgccatgcccaacacctcccatgataggcctggcctggcactgtgagcagagagagctgaccaggccttctgtggagcatctgagacaggcctggagctggaggcagtagcgagccaggagaaccagcgtgaagaacacaggaacagcaacaggccaatgggagtcgtgaatttggcttttcgaattttggaagagcatacattaacatctttaaatcaattttgaatgtactatgttctattggatattcaaaaagtttagtcctgaaacttagtactcattcagttatcccatgcaaaggatttattcacctcatcctttgagaaaaaagaattttctgtatgttagtctttcacacagcctctgtttcggcttaacctttcagattttcagataatttaggtgtcacagatacccatgataggatcgtttttcagacactataatttaaatgtctctgaaatgtaataaacagagctttgtctgggttttggaaatgatgttttcttcccaaacagctgttcatttgtattaacacttttttctgtctctaacagaaaggcagcatttcttttttatgtataatctcatcggccttttcatcatgttaactgtgtccagcgtattgttgtggtattatttttaatatcctggtgtaccacaggcagatgactagcatgacctcagggctttctgaagagaagataccgctcatttttccatagcctattctagggcagactctcactctctatcttagtggggctggctaatttcattacctattcaattcatctgagaccattttggtaaaagcgttgaaatagcaatgcgctatgagctagtctttgctcctgtattcaactggcaaagcaaaggactttggttttcattttgggggccccagttaacacccaaaggatggcaatttatgaggccctgatgaagatggtgagaactggcatttgatatatatcaatatttgatttatttgatatatgtgatcttctaacaaccttgtgatgtatataggagaagtattgttaaaattaaattttactttgaaggaattcaggcctagagaggctaaatgtcacagattcccatggctggtaggctgggcctcataccctttcctacttaatgcctctgagattcactagagagaagagtagttaacagtgcaggttctgaactcagacagtttaagttcaaatcctgtctctactatttctgtgctatgcgattttagggcaagctacttaacatgggagtaaacttcttcatctgtaaaattatgacagtcgtgctacctgtgtcacagtcttctctcaaggattgaatgagttattacacagaaatgttaagaacagtgcagggcacatagtaagtactcaacaaacattagctaggtgaattgtttaaagtgtccagcacaggaagcagcctgtaataggaaatgagcctgtattatgcctgggaggtgatgttacacaggtcctatcgagagtagacaagctgactaaggaaggtgctcaagtccagcagggaaagttcattctgcccgtactgttaccaaagttagaatatgacaatacttctgtttttgcggtacaacccgggactattgcagcctattaaattaatgagaggcagataattgacagtgtctcccactggggaaccaggtctcactctgggtggagcagttaatatgcaggtctccactctggagggataggagtgctgcttcctcatgctgcattccagaatcctttctagatgccttcaagatttatacccttaaagttggaaacctggggggcaccttgtgcccaaacagcgctaaattccaggtaacacatctccattcacaacctattgtgcgtagaccctcctggacactgctattgaccgttgactgattatgtgatcaaagattgatgaatctggaagcactggagggatagcaaaggctttcatttttttgtttgtctttttaaatcctgttccatgttccactttgaactggattgaagtcagcagtgaaatcaggagtgtggaagctgtggtaccagaggagagaaccagtgagagagacttggcttatagcaatcagtccagctccagtcagataaaggagacaccagtgagggagtgaacagaatggtagagaacaacccagctgagattccagcatccttttcttctatcatcagatacaagaggagagttcacaagagaagcccagtggctttattcggagagagttgtctggttaagcacatatgtgcaccgcaaatccacatttgagatccacccgtttacatttcttcatatcagcatctgatcaggaacctccaaatgttctagcatcctttgcaaataattttgatttggaaggcttctctggatagttcatttttactgaaagactattctcttgataagaaatttctgacaattttagttatgttaaatcagattccacatatataatgacagctttgttggtgtgtatttgtgtgtgaagcattgaaacgcatgtcacgtcctgccatcttataaagaacactgccttaatttttaactatgctgtagggagcacccagtgttcatacacatgtatgagtgtatgtcaacatacataggatgattgaaccatgaactctgtaaagtttggtagcatacacagaaatttggtaaggacaaggatttttgtgctacaaaacttccttatcaaatgcccagtagctctacgtgagttccacccaaggaccttgttgtatggacaaaagggcacaggattttccagccgttgctgcaataataggtttagaagacagacctgggattgtgttccagctttaccacttactacccctgtgaacttaggcaagatattgtagcatctcttagcctcagtttccctgtccataaaatgaggatcataatattatcaataataccttcttcaaaggtttttttttttttttgagacggagtcagctgtgtcacccaggctgaagtgcagtggcatgatcttggctcactgcaacctccgcctcccgggttcaagcaattctcttgtctcagtgtcccgagtagctgggactacagacgtccaccatcatgcctggctaatttttgtatttttagtagagatggggtttcaccatattggtcaggctggtctcgaactcctgacctcaggtgatccacccgcctcagcctcccaaagtcctgggattacaggcatgagccaccgtacctggcctgatgttaagattttaaaatgcggccaggtgcaatggctcatacctgtaaactcggtgctttgggagaccaaggtgggaggatcacttgagcccaggagtttgaggctgcagtgagctgtgatcatgccagtgcactccagcctgcatgacagaggaagaccctgtctctaaaagaattaattaataaaaataaaatggctgacaaagcatttagtacagtaactgcacatagaaagagctcaatacatattgtttattgcttttgctatttttattattgaatcacaattacctcattcattagatagaagaaatacttcctacataacagagctgggtttcagagttgactgagctaacgtatgtgaaaagtacttcgtatatgctctgaagcaccctgtgaaaataataatgattgtatgtttatttactgaggatctactaagcaccagtcactttatatactctccaattctcataacaatcttgtgagagacatagtatgattttatagagcaaatgaaaggataggcttacaaggatttgcttaggatcatgctcagatttcgacccagatctattttaaattcagatttatccttctacaaagccacatatcaatgatgataaccttgagaattgctaataatagtttcttgactttattaacggtcgaattggactcatattatctagtttaggctgatttgtcatttttttgagtagtatagcatccatggcatgctttttttgttaaaatgtatgattttgatgaaatgcacttaatacatcctcactcacaaacttgtatatgtagctacctacaaaagatatttgtaccactaagcccttggctatgaaggcagttccaaataaaagaacatgtcagcagagtcctaggcaatggcagtgtggttgaaatatacatgctgtcctcaaggtgaataatttgaagggcatacttttttgagtggataaattctgatttttattataattttcagtgctttttcagtcactcctcatgtttttacatttcagttacatgaattttcattcatattgtggattacaagtaaactgaatttacaatttgatgcccctgcctgcatactaatgataactagcttattgctcaccagctcacagtgatctgctcagattggcatattggaccctgggcatattcatgaggtaatgtatctgcctgcgagtgcatgtgtgcatctggaacctagcgtattgtaaggagataggcatggccttttcagtttggtcccttcctagctacagggctttgcgaaagtgttggtttttttttttttttttttttagtcttctaagcctcagtctcctcatctattaaactggaataataatacctatctctcagagtttcttggcaagtaaaggggtacttcagataacatgccccatactcaaaatatgtaactcccctttccacccttctttgttaccaaaaaaaaaaaagtatagcaacagtagaatatttgctttgttttttcactggatcatagttccacacacaagaaaaaccatgtctggttaacaacacaaggtctaaacagatttacaaggagatcagatgcttcgcctttcacctgactgagatgaagccaccaacgaggctgtcccatgtgtgcagtgccttctgcccagatgtggcgcaagtgctccagctgccccgacggggctggggcctcagaatccccctcactccgccttttgggtttttgctcctaaagcatcctggccgtcatcactcacatgtgctcaccaggtttcgtttctagttcagaggaaacccatacttttcacctgtgtcttttgatccctggcctgatggaatatttttctaatgcccccacttttcccaactgctctaagttacaaatggccagatttcagtcattaggagagtagaatttttttttccttttcctttttttttttttcttttttttgcagcctgtctcactgggggctggattccaaggaagcagcccgtgcactcacaggccaggggagccaggatttcaacggtgtcaacaatctttgctcatcacaccaaaaaagccctgtgtcggtgccgactcattagcatacagccgtgctgtgcttgctaacaaagcaggctctgggtatctgctagtttctcagcttgtctgtcttccttgaccgaaaagaagagaagaaatagattcaggcaagggtgctgtccccctcctgtggcaagacagcatcacaaggattcccagagagagcgagctttgaagtgattttaaagtcaccatccttgggagaaaggagactgtccaccctttgtttttctcatcttcttctatagcatcaacaagcaaaagaaaaatcgctatgttctctagttaaaaatgatcgagccctgaatacttcctggtcatctctttcatagttgttgttgttagagtgcataagaagaaatatctgtataggcagaggtacacaagcatgctctcccctcagtctgtctctcgatccctcttttgttgggggatggagggaagaagaaacgtacaagcagatgtgctgctagatctacaggcttctgccaaccatatggcatcttaaggaaagatggttggagcgtctggattagcagagtcgggatgggaagccatgtgtcgtgttggtacaggcagttgtttgagctctctctaaatggcttcaggagattgtgtaatggaacaaatggtcctgcgagcccaggaacagccttgccgctgctggagaggcaattggccctcgggcgggtactgcttcccttttttcccccagtattatgtattcttcatttaatgttcttcgaactctgagacttgactcggaacttttcaacttattacgctcgtgggttctgtctgcctctgtgtctgcctgaactctactctgtccctaatctggtaattaataatgccccagtcctcttctgtgtcctctccctcggccctccacggggggtccaggctcagcaggccagcttttcgtgcctcttgacaaaggccttttcggaggaggctgccctgctatcaggggttggggggtggagggaggatgatgtatccacccatcagaattcccagaagcctcaggagatggaaaatctttcatttcttaatgagttaactgggagttttacgtcgtcctaggtgttaagcacatgagaaatatgtagcatcactattttggacctcatgtgtggcattaaaaaaaattattctaatttcatactagtgaaagcattggactattaggtcacaggtgccatttactcagcaatttgagacctcaggattctactctctaatacataatttaaatactgtatgaatatactgtaaattggagaactgaaacactgtgaggctggcaacacatgggcagtatttcaactgtggtcaggttctcaggccattcttattttgggaggctggaggcgggagaagcagtgagacctcacaactagaacagatctggtgagtttcttctcataggaaggctctttggacatttcagctgccttttagggcaaacagatcttgttttgttgatgtttcagggtcatggcacatgcagtgcagtgtctttagctgctgatatagttaggtctgcctcctctctggggtagataacaaagcctgaggctccaggtgtgtcatacattgtgcttaatggaagataaaatggctagttgattcagtcaaagaacctgtccatttatctgactaaatcatcaaaccagtttgaattaagtcatcagcttgagtccctgagagtagctggtcagtacctggtgggcatttttgtttgtttgtctgtttctaagtccagggctggagaaagaggtcagtacctggtctgtgctgcacaccatgggggcagagtgcccttcctcctttctcacaggcaatgaccccaaaaacggaagcaagtaagaaatgcagcatccaggttaaaaatgaattcacttatggtcagctgtgtccaggctgaaaatgagtcacctatggtcaactgtgggaaataggaagctgtcatgcctactgcagcttccctcaaaggtacttcgagcaatgaaaatacattctaatttatttgctgtggaacaatgcaaaggcttcctcaaaaaaagaaatgaaacctggagaatgtgtgactgaactccagcaggagaacaggacacaagtctagaaatctcaagtgtcttcaaactgttattatttttatggatttgtgactccagcaaacaacttttactatcttaaacaaggtcatctgaaaatcacttgaagattgttaccaaattccttcataaatattttctacaaacataaatgtccaccagaaatttcagataaagtactatttctcctgtgtcaattctttgtatttaaaatttatctcatatacctaggttttaaaacacgtttttaaattttcagaactcatttcatgctgaacatgttaagtgctaggatattcttactttgtcttccgagtttaggatctctgcgggggtgtggggggtgtgtctgtagaaagcataattttgattgttatccaccaattggaagaaatccctactttaatctcttttaccttccaagtgtacatggtcccaaatttgtcagtcttagaatttcttgaaacaatgcaattaaactgcaacatatttcctaacattcttaattaagacagtgactgaaaaatgtagattaacagaagttactgtttttatcaacatattttctctctctttcccgccaccatcacatccccctccccctaccccttcttgctttaaatgtctgatgtcagtttcatccacatgtacattatgcacatggcactgaagaaacaaagtaaaaaattctcttttaattctgagctgcatgcccagcgccacatgcactgtctgttacatgtcgcttcttatgaggttcatgctgggaagtttctttttaaaggcgaagtgtttctgaaggaaagagttcaggttgggcagattgtgttagaaaaatctcactgtctccgagtggaattaatatactgattattctgtgcaggctcaaactggcagcgtgtgcaaaagttcaagagtgtctgggaattgaaatatggaggagaaagcgggagagtgagcagagacaaagaattggaagtagggctcagaagtgaaactaaacggtaactttgtaaagagaggaagggaattcaagtctgaacaactgtcatgaagcagtacttactgaaaatatttttatggaatcaggaagctccattttccatggcactttttaggaggggtcttacaaatgagtttggttattggaggagagttgccggcgggggggggggggggggccgggggagtacttctttgagttctcaagatccttgccagtttcaattaagtcacatgagaagcttaatcactaacatagaaatgtaaacgggttgcagtatttctttggcctattagccaagattttttttttcctgtttattaaaatttgagtccttcatgatcactgacaaacaatgattcattggtttacaaataaggaattaaaaggtaagaaaagcaaatgcaatcacgcagcacctttcccatcgcggggaaatcaacctttttactcattgcctctcaggggaaagaacttgggacgtgagcatggagttaatgaagctttcacccatctcctcctctcaaccgtcatcccggtttaatcctctccttctgccaaagtccagaggccctgcgagcccccgtggagtcgcctgagccagatgctccgcacccagcctccccaagccccggccggctgccctccaggtgcgggctccaggccctctcgcgcggcttcgggactcggccgagcccgggcctagtatccagagtcgaagcagccgccgggaggtctgggtgggcagggaggccgagaggacggtgcaccgcccggcagcgctgagacctggccgcctaggccaccctgcccggcgagggagaggggtgtctcctgcctggagcgctccgcggtggcccgagagcaggtgctggcgtgcgggaggcgcacgtggagccctgcggtctgttccacctgcagaggcacaattgcccagcgtggggtggaaggcaggctgggagctcccgggacgcggcgtggcagcgcagggctcggctagatgcgctcctcctcggactggttgagtaagggaggaggctcgtcctgaacgtgcacagccgctcctaactccgtcaacggaatttcactcaactccgagactgaagcattttattggcagcatttagaatcggggaaaaatctaccttctgtttagcagttgctcttttctgaagcagaaaattatctctagggatgacttagtaatagggtaccccattgccatgtgggtcagggattgggggaatgtccggatcctgccaatgcacctctgtaaaaggtggcattcagcctgggaggagaggagctggcagggcaggccgcccccagacacgcacaggcccaagctctgtcctgcagcccctcccggacacgcacaggccctgagccctgtcctacagcccctctcctgttgtcatttgctatcagggcagttctaccgccgccactaagctttgcttctcccaacacaaccaagagacggacatatagcagtgaatactgtctggatggtttagcatgtctggggcgggggtctttctattgcctgcaggggtttccgagtctacccagcaggtgctcaccaggagtgggggctgtgactgggacccatggcctgtggtgtgaggggtgaggggccactgtgtactgtaaccgggagcagcctggaagaaggcccctgctcccccttccctccggcgcctcttactcaggaaatcttaatgtgggaaggatgtgtatggggctccataagcaacactgacccagtcctggggagagacaaacccctcgtccgctctcagatcatcctcagagatcctctggggcctctgagttgaatcccaggctctcccctgctttcgcgaggacccaaggcttatgcacacagagggtttctggttggaacacctaaaagttgattgatgacagagagatggtgctaaactggcatattgcaaagcaatcttggtatttgttctttgtcaccttcctcaaggctcaaggtgctttttgggctaaaatggggcattctgtgaacgtgtgctacttttgaaaaatagaggaaggggtgttggaagcctagactggttctcttgccactcctcaaaaagcaaaattttgcagcccaaatattaaaaattgactccgcgtattccttctcccccacagtggcacacaactgggcaggctccatctcgtctgctgctggaacccactagaaaccaaatgagccctccagcaggcctaatcactctgatctgtcatggaccttctagctggaagagttatgccatcatattatcccaacactcatcagtgtgtggaggacccccttttactgaatgatttattgctctttgcagaattcctttggctgcagattttatttctgagtcactctgttcagctcaattggtcgccttcagttaccgtggcaaccagcagatggggttctttgacaagggtcagcggggaggctgccttggtttggacagaagaggagctaaataaaaagctttcagcattgacggttccgtagcggacggccaggagttgttatcaaattacttgcattaaaacctaattaagatgtgtgccaataagtgggctgtagtgattgaatctggttacttagctgctgtgggcccaatcttatgccatcacacctctgtggctagtttgactatcccaagaatggtcaaatatgaaggaaattgaggaagacctcaccacagtgtggaacgtgacatactctgggaccacaccaggagggttttagtctctgggagcaccagaaagtccccattcaaacagaaacttcctgaaaacacagcagtgtgccccccaaacccaagatggcaactgaacaggacctccatgcgtctgatagttccatgtcttccgttaagactattggtaattcagttgcaaatagcattcaacaaaataaaactggcttgtaatcactctgggttaaagaagtctaaatagagacatgccaactaagtatgaaggatcttttctggagtgggaagaaaggaacattattgggccagtcaacaagattagaatccaattcagtaggttagatgaagctattagatcaatatgaaattgactgtagttggtaatatactgtggttctgtaagagaatgcctttatccttaggaaatacacactgtagcatataagataaaagggcaatggtgcatgcagcttactgtcaactggttctgtacacacacacacacacacacacacacacacacacagagagaaaggcaggagagcgtaatcaatcagatggggcaaaattattacagtaggtgaatttgaataaagggtatgttggtattctctgtaatattcttgcaactttttataagtttgacattatttccaaataaacccatttttaaggacggctttagggtgaggtagggtacagtgtgcgtggcagtgtgggttttcctgctggtgcttctgtatggccttgagccacatgcagcatagatactactctgcaaagattctgattttcaacaatttccattcctctgtcccatttcctttgcacagtggggctatcctcaccattagtctgttcttgcttgagacaaagctgattaaggtaactcttacttcaggcagatggtcttctaggttcttcaaagtctaagattcataacgtgtcaactcctgtttcatggtgtcaggatcctttattcatgcccagtcttccaaaggtattacaaactcagccttggttcgatagcacttgtattttaagaaggttacaaggtagtgattcaacagatctaattgccctaagatgaagctgtgcctcctttttggtagaagcactgtttgaagaagttggtctttgaagagcctcggtgatattgtcagaggctttaggttcctgtcagaggcagctgtgctggagcttgaagagctgaaagtgtccccttggccatgggcccattcactgggggccagtgtggcactgtgggcttcccaacatggtcttccaagcttctggcctcttttgcatcctttgtgccaacaccagtctgtggatgagatcaatgtggctcagagtgtggtttccagagtacggtcctcaaactgttactggtctgggatgaggcaagaactgaaattgagtcagaaattttcaaaacaatcaaacactgcttcctcctttttattgtactccacaaaaccattagtctacaatagattggaaattttaaaagaattaaaatcaagtctggttctcctcactgagctcattggggaatccctggcctagggatttccctcttctcccgcccccaggcctcggaaaatgaactggtgtcagctgctgcccagaaggttacccagcgtgttctctctctcagggtccttcccttaaattctcaagtttgacatggaatagaagaatgtcgggcgtttcaaaaaaggattttgagatgctgcaaagctcactggatttagagtcaagagatgtgggctctagcgccagatttactacagacaggctgcctgaccttgggcaagtcacttatactttcttggcttcaccataatgggctgaactgaatgttctctaaggtgcctctcagccctaacataatatgattcttttcatgagaagagcaggacttgatccccccatcacttgggggcatccccaaggagccccctgttcttcctctgcaggcagccaaggctaattaggaatctgagagaatgagccaggaaaggggcagtacaggacatacattctcttcattgaaggtggtaccccctccccactgcacgatcctcaggaagaattcctttattgaaaccattattgaatagggtagatttaggcacgggaaatgtaaacagcaaaccagccactaaaagtgcgttaatgtcacgcctgtaatcccagcactttgggaagctgaggtgggcggatcatgagatcaagagatcgagaccatcctggccaacgtggttaaaccccaactccactgaaaataaaaaaaattagctgagcgtggtggtgtgtgcctgtagtcccagctactcgggaggctgaggcaggagaatcatttgaacccgggaggcggaggttgcagtgggccgaggttgtgccactgcactccagcctggccacagagtgagactctgtctcaaaaaaaaaaaaaaaaaaaaagaaagtgccttaatgttctgagcaaggataatgggctagagcgtgttccggaagcctcagcacactgcttgttctcactgataggacctcgttcacgagatggaattatgtaaaatgccgcagcaatggttaagtgttggaacaaagtaatacagctttacattaacatggtttattcactagaattaatgacctagagcagtaattgcattttcaaaacttcagcttgctgactaggtgtattgctatgtaaatagctagcgatatttgaagataggaacacagtaaaatctgtaaagtaataggattgtagaaatatggagctggaggagaatgtagtcatcttctagccccgaggctggcaaactttaaaaggtcaggtaataaatattgtaggctccatggccatatgttctctgtcgcagctactcggccgttatggtgcaaaagcagccatagacaaaacgtgaatgaatgggcatggctgggtttcaatgaaagtttatttaggggcgctgcaagttgaatttcatgcagtgttcacatattatactccttttgatttttaaaaatcattttaaaatgtaaaaatcactctcaattggcagatcatacagaaacaggcagtggcctgtagtctgaagtttgccgacctcacttctagttttctcctctcatttcacatgtgaggaaactgagattcaaagtgatcacaggatttacttaagttctcatgactgacgccagagtattttaggagcagactaggagagttttcatgtagacagttggttgttttgatgatgaaaattgaagccacacaaaaattattctccagaagaactcatttcgtatgtgtgattaatactgtgaattagaatgtaccagtggttctcatgcttaagaattcatcagagtcatccaggggccttattaaaacacatgctgctgggccccaccctcagagttgatggttcaggtctggagatcttattttctccattttacaaatggagaacctgaggttgagagagatactcagtctcaggcttaaggtaaaatagctagcttgtgatgtcccccatttccaagttcagcactcataggattaggattagagctataagtaatcatcaagcagagaggcagggctgcagttttgtttagagagatccttctagtctagctgttgcggggagtatggattccagggggccgtgtggaagcacacaactctatgagaaggctgtgcaggaacctggatgtgaagtgctggcagctggacttcaagagtgaaggtcatggaatggatgggtggatggatgagtgggatggatggatgggtgggatggatggatggataggtgggatggatgggtgggtgggatggatggatgggtggatggatggatggataggtgggatggatgggtgggtgggatgggtggatgggtggatgggtgggatggatgaatgggggatggatggatggatggatggatggatggatgggtgggatggatggatggataggtgggatgggtgggatggatggatggatgggtggatggatggatggataggtgggatggatgggtgggtgggatggatgggtggatgggtgggatggatggatggatgggtggtatggatggatgggtgtgatggatggatggatgggtgggatggatggatggatgggtgggatggatggatgggtgggatggatggatggatggatgggtgggatggatgaatgggggatggatggatgggggatggatggatggatgggtgggatggatggatgggtgggatggatggatggatggatgggtgggatggatggatggatggatggatgggtggggtggatggatgggtggatggatggatgggtgggatggatggatgggtgggtgggatgggatgggatgggagaggttcagaaggcctagagggctcatctgtggaaccaggagactgagctgtggggatggtgactaggggtggtcccacccactgagagggtcacagagagaggagcattagaaggtgactccagtgtgtcaggtggtgagtttgaggtgggcttggaaatgcaagagagaggcccgaggctgagatcaagtgctcaggatccttggcctctccacttggagtcatgagtgtagattttaaaaatcatgcaggcggaacatttccagtcaggagagcactgagcccagccctgggtcacaccagcatttgaaggtctgatggaggaggaagagggaccaaaggggagtgagagacctgtacagagtctaagaaggagagtgatgagtcgcactgtgggccttgctctgtggccttggtggcttaggtaatcctggctctgccttaccttgtgtgcgcttgggcaaatgatcgcttctctgcaccttgcttctctcatgcataaaatgcagatgataaagtaacgtgtagtattgttatgaggattaaattagggaatgtaaaatgcttacaatgttgggcatttagtaaatgctcagtaaacattagaggaggccactgggaggagtagaaaagtgagtgcatattttacagttcatgtatttgcacctttgaaatccatatgttgtttgaaaaatgttcttcatttccatgaggaagacgccgctcccagggaaatagtgagtctaagcactttgagaacacttatctaagaggaaggacaatcttagctgtagtcagagtgaccacagggaggaggctctggtctgaaaacatttcagaacaaaggattttaccactaccaccaaaaccaaacccaaaacaaaaccccaaaacaacaactaaaaccttccactgtagtccgtaggtagctcccagggggaattgtccagtgaagcaaaaaactctcattgaaaaacatacacgcataaggatataggccccctctggggaaggaaggggctggcctggagaagaaatccattggtagtggccctgtggagctggtgctaggttcacaagtgttcatttggttattatacctcatgacttatgtatacattgcatatattttgtatgtatcacatacaacataaaaaaatttaaatctatgtattcacttgctttcacagtattcatagcaaatgagtgtctgaagcataggaccagagctggcagcttgcaccgcttctgttttgcataagatattttccccagcccactcagctctataaagttgttttgtatttcaccacttgctccatcttatcttgaagccttgcatatttttttaaatgctggttctgatcatgcttgcagggtgtggctcagaggatcgctgttggaccaatggagatctgcctgggcccagcactcttatgagtcccctgtgatttcatcagcatctgcctttagaaacccgggcgtgtttgttcccatggtaactgctgcccctgacacgcctgaaattcctgggatgcccttgcgtggaaggggagcccgtgctgcccattctacccctgcatggggcagctgcttttctccctcagggtccccagtcctacccaggcaggggtggcagttgttcatctgcagatcctgaaggacatggaccctgtgcctgagattaggacggccgcaccagcctgggtgcaggctccctcaagtgtccttcctcatggacccgcggaccctacgctgtgctgtgagggccggggagcacaggggcttcctgggaggaggactggcttcctgcccctgatggggcctggccacagctcccagggctccatgacagcacagtgaagatagcaaccacatcctgggggccctggatgcaatccctgcctgttgcaaagatgagataaaggcgcgggaaagaagggtctgaattaggggttgagctctgaaatcggacgattctgtgtttcctgccgcatggagggcgtgtgtggttcgcaggctgtggggggcttcttgcagcgggggctgctgcctaaacagactccgcgggccccatgatggcaaaccccctcgccccgttcatgacttaatgcctcctagaagaaaaggctaaaaacaagacacacagaacaagaaattgcactctctcaaaacgacagtcgccctgaaacggacgctggaagaggtttccaggcccgtggcgacggtgaggggggtgaaggtcgcaggtggagggcacggggcggcggctgcggagcccggggaggaggcggcgggcgcccgggtcttcctcggagcgcgccccctgggctgggcggcgtgtccctgcctcccgccggcgccctcgtccccgcagcagcgtccccgccgccaccccgctgcctcgtcgcctttctcgcaaacagcggtgccctctacgtgggggatcctggaggctgctgagcacgagcgccctccgcgacccgcccctgctcccgcctccactcttgcctcggggggagggtctcagtcttctgcctaaggcgccctcctcccttgggaagtccgccgtcctctgccgtgaagattgcccctctctcctccagtgcctcctccccagcggcttcggtggctcccaccctccgcaccccgtctcgcgacctccccgccagcccagcccctcaccagaagaggctttctcttccagcccctgaaatctggcttctgccccagccaggaggctccgcagggcgctccgccaccaggtggcatttcccacaaaccggccactccgccctgacccctctcctccctggacctccgtctcccagttttcctccctccaggatcccactctcagtgtcttgccggattccagtccactgccagccattgaaggcggaggttccttaacccctatcctggggcgagcccttccctctcactgcagaagagcttctcagctaggggggtcgtgcgggcccggagagctgcatttttaacaaactccccacactgacaatctttgccaacccttcccaggcaaatcttgcccccacgttcatggtctcgcctcccagcaggtttggcccacccagctagagctccagctcggcccttcctaagccccaagttgcatagctgcctggtgggtgcgtgttccacaggtacctcggactcgccctgaccccagaacgtctcttctacgccaggccgatccctcctgccatcctctgtctgttaaatggcactgccattgcctgcaggacgaagtccatatttgctggtttggctacagagtccagcgtcgccttcctctgagcagcctgcagcctctggtgcagccacactgcacagcttgcagtttccagacacgcattggcctttgcagtgcggccccgaagtgggaaggccccgcccctggccctggccagaaaagcacccactcatcctttcccatcccagcttgcccgctgagtgactttgaatcaatgattcatgttgtctgtgcctcagtttccttaaccttaaagtggcataataattagttcctgcctcatggaattgtgagtgctaaataaacagtaagtctagtgcccgacataaaagtgctcagcatacgacgatcatgagccatgtctaagcaggcgcaagccctcccaggcttctcatctgcaatattggccatttctcttcatgcctcagtgtcctgtttgagttgagcatgttttttttacaagtgagtctctcctccattggccgggaaccgcccgagagccgggagcatttgtcattcttgatggacccccaggtcttaaatcagtacttgacccttaagaggtgttggccgggcgcggtggctcacgcctgtaatcccagcactttgggaggccaaggcgggcagatcacgaggtcaggagttagagaccagcctggccaacatcgtgaaaccccatctctactaaaaatacaaaaattagacaggtgtggtggtgcgcgcctatagtcccagctacctgggaggctgaggcaggagaatttcttgaacccaggaggcagaggttgcagtgagccaagattatgccactgcactccagcctgggcaacagagcaagactccatctcaaaaaaaaaaaaagaagaagaagcagaagaagagaggtgtttagcaaggcttggttcgtttggtgaattaactcagtgagttaaccaccattaacgatggttaaggacacttgggcgctggctcgatttgactccgagctttaccgattacttgtgtgactttgtgcaagttaattaacatctcagcttgttttctcatctgtgaaatggggatgatactagcatgtacctcctaggactatagtgaacttttaattaagataattattgaatttaacaggtagtttattaatgaaatttacataggtaattgtggcgcagtgagcccaggggctcaaggtgttagcagtcatcaacagtgctatttgaaactgtgggtggatgaagaggtgaactcaacaccacaaatatgacagagcagtaaccaccatggaaaagaaaagagagcttatgtgtctaggacaccccaagaaatctcttctgaatgaatgatggcaatgaaatagccattaacagagggtaggctggtttgtgcagggttggaggcttttccaaaaataaataactttcaaaaaatctcagccaggcgcggtggctcatgcctgtaatcccagcactttgggaggctgaggtgggtgaatcatgaggtcaggagttcaagacaagcctggccaagatggtgaaaccctgtctctacgaaaaatataaaaattagctgggcacggtggcaggagcctataatcccagctacggcaggagaatcgcttgaacccaggaggcggaggttgcagtgagctgacatagcaccgctgcaccctagcctgggcaacaaagcaagacttcgtatcaagaaaaaaaaaaaaatcaatctcgggccgggcgtggtggctcacgcctgtaatcccagcactttgggaggctgaggcgagtggatcacttgaggtcaggagtttgagaccagcctgaccaacatggagaaaccccgtctctactaaaaatacaaaattagccgccgttgtggcacatgcctgtaattccagctactctactcgggaggctgagacaggagaattgtttgaacccggaggcggaggttgcggtgagccgagatcgcaccattgtactccagcctgggcaacaagagcaaaactctgcctccaaaaaaaaaaaaaaaaaaaaaaaaaaaatctcttttcccaatatttgtaatactgggagtgttcaagttgatttaaaaattgagtcaattggaatccatcctcagctcttagctgtgaagggagagctgccccttcttagggatctcacttctcacagcaggggtgcttctgtgtgtggacatcctggtcagctggtcccctgctgtcttgtggggctcacacccaggcacttgattcagcggggtctgggtggtgtctccttcctccttcccaccccagtaatcgctatagccttcccaggcccccaggttgcaaagcactctggactaaacctcctccaggttctgagggctccataggaggaaggtctaggccagaaccggccccatcgctgaaggtggagccagggtggccggccgtgaccggtgtttatgctgtgagagcggctttggccctgcccattgccctggatgggctgccatcccttttcaggagttcaaaaccacatactgagcccatcggtccaaaggaccatcatctcatttgatccaagcacagggcaagggaccacatggacaatggctgctcgtggcaccttcttgccatgcagccatgtcatggtgtcacttgtcacgtttcctggcaccttcttgccatgcagcaatgtcatgatgtcatttgtcacgtttctgttccattcttttcgagcaagcaggaagccacggggctacctcagttgctcttagccagtagctctctccacaggtaggccttcatcggaggggaaaagccaccttagggttccagagctcaagggcgaatgatgctttccacccactaatttaaatacggaagcatcagattgtctgcttctcaaggaaaagagctgttaccatctctgtctcttcaatgggacccactcctgggccccacagcagggcaggtgctcagatgaatggtggccgcctgcctgtgtcagagggtcggcctaggcaggttccccagtccgctggcccgggacgtcctcctctctcccggccgctcactgttcaggacagcccgggcccccccctggggccttgcaggagagcttctgtgatccactgggtggctttgagggtagctcccaggaaaggctgcctcagccccagcgtgatggggacgggtaggggccgatgaggcttcccagagcagcgatggccttaggtattgccagaaggaaacctacttttcctccaagatcagagggaaggatgaggtggggtgttggagcatcaccatatatatacatcacacacacagggaaacactcctacttggatggaggatctttgctgttctgttgaggccagcctgatcctggaggcagggcagggcctggctgttgcccaggctccaaagaggcgccagggcgtcccttagtccttacactttctccagaacctgcgggcagcaggaggcccttgtcgggacaggcaaggggggcggtggtgcggaattgtgggcgtggcagtcggaggtgccaagcccggggaggcggggcttcctgggagcatgcgtagtgccggctctgcctgggcggggtcctaggctgctgctcccgcctcccccggcacaggtagggcgccccgcagacccggacaacgctgggtgtggctgaaaacagggagtcatggtgcgttctggggaagggtcagggctgggggctcgggcccctggaccaaagactctagccaaatccatcggaggctgagcagggcgatggggcagggccgggggagccgtggggaaatgggagggtgtgggccgagcagcgccggaggcaggtaccgaccatcgccgggtttcccagagggcagtggtacctgtgcccacatgtgcggccttttttgtaaaggaacctatcccaacccgaaggcccaaacgtgtggccgtgtaagtttagttgtgcccggagtcccaggagagcccggactgagggcagccagaggccggtgtccgcagaacggcccacgaggccttcggctcagtagcctggagtttgaaatgcaccttgagctttaatggccttttccttgtgagaattcgagttaacgtgcctgctggtgcttttgatgggtgaggacggtgaggcaggccacacatctcgcttctttccagaacacttctgggtagtcgttcaattccacatttaatccaaagccaacagttccatgggtgactgtgctgctggctgtaggaagccgactgtggacagatgaggataatggtctgagtgaattagcaagtctggagaggagcgcccatcagcagaatgacaaatttaggatctttaaagacatctggtcagcgatgccggagctcgtgattgactgagtgattaataatggaaaacccttacttcagtgtttccacggccctcacccacttccccagccggggcggccgtctgctcagcctgccagagacctttccagctgaacaatggcggcatttaggcccctcatctttgacctctgcttgggagttcaaagcttccttttccttctacttaccccacttatctgcgtgttttctaattgatagtgtactgagatggctcccagttcccacgcacatttgctagaatgttaccttcacacagtgcgtaccaaggacctagtgccagccagagcctggcacctcagggtcaccctaggcgtcctgctcatggttccctatcaggggcttccctcagatacacacagcccctgggcctgttgaaaggctgacgttatccctctttaattctgcggtggatttttctccaggctaaggcagctggataagcacagccaggccacagcccagcagctggtgcagctcctcagcaagcagaaccagcttctcctggagaggcagagcctgtcggaagaggtggaccggctgcggacccaggtactgtgcagaacgcggcgcaggtgggagtccttgggcgggcgtctacaggtggatcttttatgcacctcaacaggccggctttctcacggatcacatcggttagcagtaagctgggagggaggtcccgaagactgtgctgggcacagtgcaggacccagagaagcggagccatgggcccgtcctggtgagggagttaaagtccgtgcaggtgaacagaccccggcccgcgaatcaacgaaccacaccgagtgccaagttgcgccgtgcaggctgcggagggtgcgagagcagggagaagcgggaggacggccgtgggcggcagaacaggctttttggaggatggtggccttgagctgcctctgaaggtcgtgtatggtttgaattggttgaggaaagaggtgttcccaattagcaaagtcgtcttgaatggaaggcaggcatctcatcctaaattagctgactgattactgggctaatatctggagtgcttgcagagcacccggcagtgttacacacagaacatgcattaattccctttacccttgaacaagcaggcgatgctgactttattgtcttcatggtttagatagggaaactaaggcccagacaagcattacagctggcaagtagggacaccgcaaacggaggctaagcctgactccacagcccaggctttccccattcaggttagatccggggccaccagcagggaaaagggaggaaggaaagtgtcccggtgaatttggaacacagtatgaaacctcgtttgctaaatcgcttctcttcctgtcagagaggctgtgcattttgccccgtcaagcagtttgttaggataatgaggtggtccgtgggctgaccaaggcctccgcctttaattaggattgcacccaggtgctctgtgagtgccctggggacttcaggcagtaagtgcttggaatgattaatatgaaaaatgcatctggaaatgaaaacgaagaggagtctcattctcctcacaaaatgaccctgtgctcaaggaacctgtaagtactgacttttcccactcggtccaaaatccctctgccaaacatgtgttcacagacagtaaatgagcacacccaggcgccacggagctaaggcctggaggtggaaatgcctctactgtccccatgcttctgagactgctcccagggactgtgggggagcgggccgctcaaagtccgagccacagccgcactgccacagctaatctaggaggcgaggcctcacctggcacgctccatggcagggccctggaacctgaattttgccaagctgttgggatgattctggacgacactacattttgaaaacctctgaagtgtttggagctggaaagaacagagaattattccaggttgtgtcactgtgctgaatcccctgcccccgcttcggacaagtaacttaagcctttttccagcctcagtttctcctctgcacagtgggcatggtgcacgcctggcttcacgggctactgggagtgctgagtgcaggcgggatgccccacgggcccttgggcacacaggctgaggacgtgtgagggtgtttcctttctccctcatcttcagagggtcctgggagaggttcagggaaggcagaggcctgcagagcagcagctgtgggaccagtgccactcccctcccctctgctttcaggatgaccccctcatcctccaccagacccagcccagaacccagccctgtgggcaggtccccagggagggccccagcagcacctgctttaggcctggccagccaaagatcaggaccactggagccactaggtctcctggcaggtgactaggctcttgtcacataggagggagggaccgtgactcctggcatgagtgaatcttcagcctctaaagccaagaactctgtcagacctcaggttgtggggagtcttccgtggaagctggagcacacggcagcttcctttgggctctggactagatcaggagaacgtgggctttgccttttaactccccatctgcctgctttacagcacacttagatcttaacatggatcaccgatgcttagaagcttcttccagggctttaaaaatctggctattgccaaatgagttgcaaaattttcacaaaacgcattaaaaaaaccccaaacctcaaaaaatcctcagaaaaactagcaggtctttctttcttcttttgcctgaagcaacagcaatgatttgcccattcctgtgctatctgatactggcccatctggctcatctctaaagcggcctttcagattcaaatattacacttggagttattttaatatgaacatgacaaaagaaatttggtagagggaatgttggctttcagttgcaaatactagtggtcagagaggaggcagggatccaggtttgcaagctctctgctgaatatctaaacccagagcctgctttttctggctaagcctggccttcacctctaggtaggggctgtcagtgggcttcagcctctgcgatgccttcttgtcatggaatcagcttgagttgtgagttaggcttctgctgagccatgatgtgggcgaggctgctgtaggttcgagcaggtattttggatgcggtgccgcctgagggctccggagtgctcagccaccctctctgttttcctggagtggcctgtgggtccagatcttgggcagctgagggttagagctgtcctcatgtccgggttagagatggtttaactaaaggcttccgttttctcagcctggatgagttaagcttaacttaattttgcatgtcaaactctaaacatctctgtccacttaatacccagaagagaatgggtcgggcaatggttccaaagcaaagtccacccctttccttccctccctgtcctgggtcctgagccccgctgcccctggtggtggggctcaggctggcctgtggcctccaacaggaagtgtctagcctgttggcaggcttcattattctaattgtttctgcttgaattctgaaacactcacaacaacatggctggcagagggagcccctggtagtggtagctgccacatggatgcttttggccacgagaacccccatcctccccgctccccggcgctgtctgcggtgggcaggactcagggcactggctcaagctctcggctcgtttcttggcttttttttttttttttttttttttgagacggagtcttgctccgtcacccggactggagtacagtggtgcaatctctgctcactgcaacctccgcctcccggcttcaagtgattctcctgcctcaggctcccaagtagctgggattacaggcacccaccaccacacctagctaatttttttgtatttttaatagaaacggggtttcgccatgttggccaggctggtcttgaactcctgacctcaaatgatccgcccaccttagcctcctaaagtgctgggattacaggcgtgagccactgcgcccagctgtttttttttttttttttttttttgatgagttttgttcttgtcgcccaggctggagtacaatggcatggtcttggcctactgcaacctctgcctcctgggttcaagcaattctcctgcctcagcctcccaagtagctgggattacaggtgcctgccaccacgcctggctaattttgtatttttagtagagactgggtttctccacgtaggccaggctggtctcgaactcctgacctcaggtgatctgcccaccttggcctcccaaagtgctggcattacaggcatgagctttgcccggcctcttggcttgttcttagtttagggtgactacaaataatggcattattgatctcctgcctcacctgggttcggaaacaacttcaagaaaatagcttttaaatgtcatgaaatggctcttacttgtccttgtggagaaacagacactgaagcactagcccagctttgcctagatgcagttccccacactctgtattccgggagggtcagggcctccagacacacaccctggcctgtcttttgtttgagactgggctgggtagtcgcactctcgccctcttgagaggcaggccctggctgggggaggctgaaaccttggtggtgggggtggggggagggggattcggggtgagggtggtgggtctcaggggagtttgggcagggcctgacagcttggagcagggtcaggggtctgcggcccagagcctgggggctctaacatctggctaggaaggttggagccagctggtgaggaaacatgagtcttggggagaatggcatctgggacaggggaaaacagaaattatctgtccacttagaggatggtctcaaccatcaagatgattttctgtgtctgctttcttatttggtaatgaatacggttttggctgacttgcattttctggtagccgtcgtatcctgagcaggctgcttggttctgtctgcagtgttcaatctggggagtgattcccttttagtcccctcatatgaatcacttacagtttagaaaacagagtcggaaactgacttgtcagtggttaatcagttggccctatgacttttaagcattcttggcagtgaatttactttctaatttgatttaaacttgtgcatggatccagcagccatatgtgattatattcaagatcatcgacattatctcattataccaaaggactcatagaagagagccgaaaacaagcaggggacacagagacacagaagatgatgaagggaggaaaggcccattgcaactggaagcaaagggagaagggaggttctagaaaagtgacagctctcagggagcaagactccctgccgagggaggcctggctgcaaggcggagctgctgcaggctgcccatgttaggccttggaggtgtcacctaatttactgtggtccttccaggagccctgggggcctcgcccagctgacttaggagctaccacaaagttagctacctgtaagacagatggcgcttgaatagaacagcaaatacattgaataaaataaattaaaaagcctcctcctgaaccaagattttttggaaagaattctaaatagatgaaaacaaacaatttgatttcaaccaaattgttgtttttttgtttttatcctgattttcacccgaattgtcagtctcaaaaataaacactgatacattcccagaaaatatttttcaaataaaaactgactctgttaaagtttgccctgattctttcaaaactgtgtacaagacactgtcaaccaaagtgacttgcatatttttttaaataaacttgaacatatgcagctaaaatgtcattaactccctgctgcctgagtgtttttaaaaaatgacacaagaccctgggtgctgcatgtctaacataagcatctcgcgaccttcggagaaacttccccaaacacctccaacagcagacagttaaactttttgttttttgactgagcgccccgtgtataattaatattgaaaagcgcatagggcttcattttagccagacttgctcttccgttaacagttcactttgtccaagagtgagtactttcagaataagaatcatgggagaaaagtcaattgaattttatattccttcagatacattcactctacttattgcttcctgagtcagacattacatttcacaatataaattcacaatcaagattttaaagggagctaaatattttaatccaattagacaagtgaacaaaacactgaatattgcatgtagtgtagataagtggttcttgcctttaaaagactgtaattccgtcacattacaaccccaaatgtcagtgttgtctttatttttaacactttcaaacatgaggcagccagaggctccactctctgctgttggtgacactgtctgtcctttgggaattcttaaaatctatttaccatggaaacatggttcatataaaacacagacctgcctgtgtgtagaggaagttctcatgactcaggggacttgagaaagctggaagatgacaaactcagaccccacggttgggaaggaacccttgggcttgggtgcgccctggggaggacaggtggcaccgcagagccagggcctccaccccggcctcatgtgtgctggggcctccctggcctgtgcggggccgcctccctctccccgccaagtccagctcgagatgctgtcttacggaacgtcccacttcatgtctgcaaggcggccttctctgtggatacctttccattcctctggtttctgcggccctgttcctttctcggagcccagaagcagcaaagccaagccctgcggtggaagggaaggagggctttgaactctgactgcggtgtggaggctgttatcaggggcccagccgggcagccaggagggaagaatggccgctgccctgcgatggccttaaccgtgagcccccgcctgctttgcagctggcagagccaggttcctggaaaggcctgacccggaggggacgaggcccctcagtgagaacttcagtcgctgtgctggggacagcagggccgcaggggcctgagggtggctgactgcccctcggctctgtagaggagtgctcccttctgacaggtgggcggtcctgctcgaaggccgcgtttccccgacgttctgcccagcatgctgagggcacctctctcctcagtgcgttggtggcgagccagagctcacgtggcttatttcatccaggttgccttcccaatttggcagcttaattccgtagatatcaaactggctgcccctcatctgccagagcaagcaggagagcctcgcatgggagagtctggactttgaggtcaaactgcctggattcgaatctcagctctgcgttgcttcagagacatgtgttagctttcatgtcacttgatttctggcagagaaaaagaaagaaccagcttccctttaaaaggaagtgcctcatattacccagagcccagcacagatgattatgaaaccaacaggattagtgctgagatcattgtgggcttgaaagggccatttgagataaataaccattttgtacagatagaaaaataaggcccagagaaatgaagtgaatggaattgggaagtggctgggcagggaaatgaacttcttctcaggccacaggatgtgtggatgggggcaggtacccgagcgggtgcgggcggagccgggcctggctggaacagctgccgagccctggccccggtgcccagaacacgaggcggaggcgggaggcgagccaccaagcgaggcaggggctgccctggagctctgtcaactcagggccagctttgaaatgccccagatggaggtagggggaggggcctgccctctccagttacaaatggatgctttattgccagacacacaaggaacaggaccacgttttgacttggccaaacagagacagcgtgccagtgagcagagcggacagcagggggggaaggggttgttaccttcagaagggttggctagagccacccacggagacagtgaagtgcgaagcccgggcaggtctcctgtgagcaggggcgaggggtgccaccatctccccgggctgccacttctggctggtttgggaacaaagcagcagcaaaggctggctggaccccacagtgtggttgcctggggaacagttcaggtcacccagagcaactgatttcttacactcagaacttaacaaactttagaaataaatgaggcagggtttgtggagagatgactccgataggatttaaaatgagaacaaagaaaatgggttagcagctgtgtgcctgcagatgggggcacgtttccaccacctgtggacagcacggcaggggagcagtggccagggcgccctgtcgcccccctctgagctgcaggacagccacaggagggccacagcaagggccatgatgacaaatggaagggcagaaggacgggagacactggctgagggctcatgtcccactggcatacgcacgctctactctcctggacgagaccatgatcactgtggtgttgatgacaggacttcctggaaataagcatcgtggatatccctaatggcagacaagccagatgtgggcagtaactaaggcttctgtctcggtcagagaaatgtgtgttaccaaagagtcagcaaatggaggcgacaaaacggtgacctcctaggacaaattatccagccctccagtgctgactgaacgctcaccatgggtcaggcacggctgtaggcacgggtgggggggggggcgttgagcagtgaacggtaagttcaacagtgtgaaagtggggatggatatggggcttctcacctgaaccgcaggaaatacaaagcccatagagatggccatggctgatctgccgcaggaaggaatcaggctgacttttgattggttcctggtgaggcccgtacatctgtgtcacccccatgcaggcccacggaatcaggaggtcacccgtttctggaacagctccgatagtgataaattgctaggtggcctgggagcccacaggcattatgtagactcatcatgagaaatgcctgtttcctggagcttatcaaaaaattccgcaacacattttacttttacttcaggtctttacgcctattctgtattgtgtgtacgtgggtgtgttctctacccaaaattcatcactgcagccttgaattctgggctacagcaattctcctacatcagccttttgagtcgctgggactacaggggtgcgccaccacacatggctaatttttacaattttttttgtagagatgaggtctcactatgttgcccaggctggtctcgaactcctggactcaagcgatcctattgccccagcctcccaaagcactgggattacaggtgtgagccactgttgggttgtttttcttttgaagtgttatctgttgggatttatgcttatcccttttgtattcagtcatcctagcatttctaaagttaggaagccactgtgtcaagagcgaggccaccaggccacctgccttatgtggccaatccatggagcaggggtggagggccattcaaaccagtcatttagcaggactgtgctgggtcagttcgatcacctggcctggagggcacgtcagcttggtgcaaaccctgcgtttgacaatcagatcgtgttggtggcagtctccgtgctgtcagtatcccactgaggacagaagggagtcccctctgcaatggcagggctctagggcatagtgcatggggtggactcctcatgggccactcagacagggcctggagaacaaagcatcccgtgggcccaggaaattgtccacctggctccacgggcctgggagggctgtgtgcatgggatggcaggtttacgaggaggagtgaggcctcctgccggagccccacctgcattcagcctgaggccaggccccccacctactctaactaccctgctgagaccaccccactactcacagacctgttcaagaaaaagttgtcctcagggtctctcacacactgggaaatctacttgaaatgtaaacattactttttctcatttttcataaaaggcaacaggctgatgttcatatatttctcttgaatgcggattcagtttcactcattgccctgtcttggaaatccccatgttaatgatggcttaaattaggttgatagagtcctcccttggagtccagcttggaaaatcctcactggagaggggcaggcccacttctctttttggaagatggttcctaactaaagaaagagggaccagattgggcccctggccctgcagtgcgtcccaatttatctgacgtagaaaccgggatttggaaaataccatcctggcttttctctggacttcacaatctagagggcgaggactgtggcccagtcaccttcccacacagtgcacagtagaaactccagacatgctttgtggagtggaaacatttccagtggcttctgactctagttcctgatgtggtttaaactaatttgggcagccatggcagcagaggccaggaacagtattcaatactttctgaacttgtgattctcccccaacctgatctgcatgaagctactttggaacatttgtatctgcgtaaaactaagagacctcagtacacccaatcccctcttccaacacatgtgaggtttccatgtgaaagtactttttcataggttacaataaattgcttgcagttacaaatttggaggtgtttcagcttgtattgtttcacgaggaatttcttaggggcacttggcctacaccctgtttttgttctagaattacctgccgttaaggtcagataaattttcagtaaacagattatggcacaaatcaatgtgtcctttcccggacagaagagatggctctctggccatgtcctaacaccagactgtccttatttaagaggcaggcgtgtcttttgtctaggttgtcttcaaatttaacccattaaaccagttaaccttatttcatatgtgaagggctttgatgtggacaagatgaggcacaaacttttcatataatttccacatttttagcaacaggtttttttctccaacaacagttttcatcataaaaggtgactaaaccagcaaatgagaagacaaataacattgaagaacatgagctattgaaacttactttttattattttttccagttacccagcatgccacaatctgattgctgacctggatggaacagagtgaaataaatgatttacaaagagatatttacattcatctggtttagacttaatatgccacaacgcaccacgaccttcccagggtgacaccgcctcagcctgcagtggggctggtcctcatcaacgcgggcgctgtccccgcacgcagtcgggctggagctggagtctgactctagctgagcagagctcctggtgtatgttttcagaaatggcttgaagttatgtgtttaaatctgctcattcgtatgctaggttatacatatgattttcaataaatgaactttttaaagacttgagttgtaatgtttcctttttatcttgtagtgatgaacaaaacacaccaaaaaggcacatattttaactaggccaaagtatattaaggaccaaactttttttcctgccattcatttttcttttcatgatctatatatcaatcatccttcacctttaatcaatgtcccatcagactccattttatttatttatcgtcctactttgtgcacaatcaatcaatcaggagacaccaggaagcactatgcattactctttccattctgttaaacaacgaaaacagacaaaaaagcatctttggctcggtggtgtcagatttttttcttcaatacgcagtatttgagaggagcctaaaaacgtacttagtgaaattagaaaatttacttagagtatatcaaatatctgtacacagataattatttgtctaaaatagtatttctactatacacaattaagccctcaaatgctttaaagtaataaaaacggacactggacataccgtgttgtatctgagaatgacaaacactaaaggcaaggctgcagttagttaggacaggtccctgaccttcggctgccctgcctggccagcgagccatcatcctcatcaccatctcaacacagagctgatgtcaccatatgctcagccttgcctctcagaagtgatgtggattaggctttggaggcggtggcatgatctacacacagagaccatttgaatctcttgagcatgtaaaaggttcaagcctgaaacagtagaacttctattcagattcagaagttttttatttcatcaaatgtgctagacataaaggctgtcacataagatattttaattgtccttaattctgttttagatatactgtgaataaattatacaatattctaaaaatagcacctttaaagaattatagaggtcacttttttttagcctcctggatctgtcaaccccagtggttttgagagaagagcacatgtgagaatgccctcaaatttggccgtgtgacatacacatacatgcttgactcactctggtcccaaaagccattcctctgtctggcttcgtcacaggagcaaagccaagtttctacaatagtagctttatgaggtaaaatcagaaaaaggccccatccagaatgattcaacgtgaagtcagactgcagtccagccatcctacccatctacatcacccacgtctaagtttgttaatttgccatgacatgttgttagaaatacactctaagaaaggaaatatgcagagcagtacattatcaggaagacgttaatgaaaagctacattccttcagattctgggtccaaaccgtgtgttgtatagatgattcgggtctgaatgtccccagggtctgagacctccttcatccctggcttcacagtacatccatcctaaatccagtgctgagaggtcagcgtttcccctcagaagcagccgttcatcaaagtttgcacaaccgcactactgccatttcactgaagtaaaaatgatcccctatgtgtgtgtgtgtgagctacaaggaattatttctatattttcctgtcacattttatacaaggtaggttaataccagctggggctattaaaaatcatgttttcattaaagaagatttaatttggggggattatagaaccacatccaacaacaataaacagagaagtagcagattgacatagtgctttatttaagctgtctgtacgaaggaaaatcatgttcatccctatcatatacgtgtaaaaatactaaggatgtacagtgtacaaaaacagtttctcctagttattccacatccttgtgggtcatatacttcaggaaatagacaggtttagtatgaccaacagtaatagtaatacagtttcttgggtttatagttgcatctgcttaaaatccttaaccagatgactagatcttgcgcagatctaatgaaagaactagcaaggtcaagaaatgtcacaaactataaagctacagggaggtaattcaattaccaatttagaggttttctttttatttaaataaatactttacatttcatgcttgcctgtaatgcactaccaggagcaagataaggaaattctactgtagacagtacaaacagtagcagcaaagtgtgtatgttgaggtgtaatagagagaccctgcagttagtaaggaaggcccttacttttgtactctaggagaagcaagtggcccctgcaagaacagtcagctttaagaagctggaaatcagggatgggaaatggaaaacaatacttgaataatgctatgtaattagtgtagaaagcaaagctgagcgcgaccctgccaaccatctaagcagaaatggccaatttcctccaagatggctgcattatgacaagaagtcaagcttcatgacagttagtatgggctggagtctgcaaagtctgaactgtattctcatagaatgattccaggtttcagggtgttccacctgccagaacccaaaactacaactatgggcgacacaagggaagttttagaaatctccctctacacgcatttctggttttctattattcctccatggcagctgacagatctggaagtgaaaataggggattctcaaaatcaaagccaagaagacaccttgtgtgacaccaatggagtctcagagggtggaatagaagtgactgagccccaggcatggctgggaactgagagccagtgtgaggagtggcccgcctggggcaatgtcagtgccagtcattaatctttaagaagtgtccttggccaaggtcatgggaatcactttaagatttgcgggagaaaaaaccaaaacaacaaaaagctgtgtgcttagtgttcggtgtcatgctttccctctagaggagtaagtgctctgaacatcagccagtctcagctttctgctcttcctctcacctgtttctttcttatataatggatgcaagacaacttaaagaacataccttctagtctacttttttgtcaaaatgaaacattcaacataattccaagtgaaaaaaaaaagattagctatgtgtgtaagtaagaatgaactaccatttactgtaacttcctactcaatactaaggatgaacttcactcaggtagaaatatgaaaaagaaggataacgttgatgtctgaatatgtcttagctgccttagtaaaatgccctttaacccccgtcagtcccagtggcccacccactgccagcagtggtttcatagctataaatccacacttccagcgtcaagaggctaagacatctgcatatgaatatgattcatcctacttagaaagtcacttgctctttcatacaatgcaatcataatactacgtcatgctgtagtcttccgtttgggagctgtcagagtttaactaaaatacatttccatgatcactccgcggagtaggatggccttctgcttgccgcaagagtggcccccagcccctaggacttcacaggctgctttggaaattgtcagctcctagcaccaaagggtttaatctgaagatcatcattaatgaaggagaaagatgaggtttgcatacatgccccctttcagtgagaaatgttggaatctgggggacatgagtatatacagaaaaagaaaagctggaggtgttctctttttttgttgttttttccctgatggcttaattcagtgataaatgtaccatgatcccaagaaacacaccaggttcttagccttcactgcccatttcctaaatactcaagatgtgttcattttgccacgtaaagatcatttcttatcttcactcaggtctcaattttcttcattactttttgttgccaggtcatcataacgtttcaaattcttaaatgagcaaacgtcaacagctatttgtttcattaaccccttggcatgcatagttggggattttctcattttcagtaccaaggggttaaatggcagcatctcttctcccaaagccaaattctaaccaatatattccatttcagagccttatcattttttttaacagaggagaaaaagtgcatgattctcatcagcgtgtacaatccttgcacatgggtcaaaagtaactgcagtaagtctattttatataagttggagctgcgtttgctaacatgacatacaattctcatcactaaaaaataaatactactgcaatataaacaaaatcataaaaggacattcaaagtttcaacatctgagaaaaagctaattcacgtagaactgaaagtaaaaaattaaataaggcaaacacctgtttaccttggtgtagaaattttggtgaaaagcagtatcattatacctgtctacattcttcagccatcagaggtgataaatgtcaagaaggaaaaaaggtttccaagcacaggggaaagatgctctctggctcaaattgtttcataagaccctttaagtgaccttgactgtgcatatgccttcagttcttggtagaacagtgttcacttgctcatgattgcccgtgaagtctcgacatccacatgtgatatgggcttcttctacagtatccaccaggaatttaaaaaaaaaaaattatatatatatatatatatcccaacagttgttcagtccttctaccaaatgcttcctaatcaattccagccacagcttagtgatatatgcctacttcacgcacggatctgatgtgctttacatatgcacgccaccacccttccacaattgcttgttctgaatttataaactaaatcttcttagtctagttagtttttctcttctagaaagttaaaaaatgtacctagaatcagtgtatctcatttagccttcactgagggaaaaactaaaagatcaaaagatgataattggtgcacaaatgaacaatggtgggctcatgacttccaaaggttggaaaattacttcttaaagttgctataatagtaagacagtagcagcaacagcatgagaccttagactgagatacaatttcatgcaaaaacaaaaactggagtgtatttgcgtgtatgtgtgttttcatgagggtgaaaggtggcgaggggtgaggacccttggctggtctgggatgtcggaaggtgcccctgctatgtgtaagagctaggactggtgatgtccaggaatcattttcagtaataaattgaagatgacagtgaagtagcagaatgaaagagacttattctcgtccacttgcagagtaggaaaattgagggaaatgcggccgcctctcattgtccatgcagtccataccatcctcatcatctgtgggcaggaaacatctattttaattttacacattcattttttgcaacattatctctagtctatgttttttaaactctgaacataggaaagatgaacagaggcaatagctcccataaacttgtgttcatcaataagctgtagagtaattatacttcaaaaatcatctgattttcataaatacatagtctatgaagaaataatactatagaatcatctctaagacatcaaaatttcaagactcaatgaaacagtgaaaaaaatggtattgaagaaaacagaagtttttaagaaggagcagtcttcagtaacctttcatttcatgtaaccacatatatcaaaactgcaagtcagtgaaatccacagcatccaaagtctgtatagaattcatcatcgaatgtcttcaagtgcttatattttttctttgtgatgctttaagtgcaactgcaaaataaagcttcttatgaaatttcattcaacatctagcatctggcttaactcacctttcccaatttccctatgataaaactttagcatgaagggactaagtgaaagaaaaagagggaaggatgtcaacatctgagtcctagctcatcaggaaacaatggaagagacttgaaaggcatcaaaacaggccgctgacaatcacagtgttcctcctgtcagctttcctggtttcctgtatttcaaagatcacagatgatcagcaccctgttctcataaatgtcctgtgatgacagtcctgtgctgttggaagctcttcctggtatgtggccacgtggtcagccactcagtcaacatgcgctcccacgcatctgctctgggctgagcacccgtcaggcccaaggaccgcagaactttgaacaaagtcccaagggccccctggcctcacagtctcctgggggaggtgctccattttaaatcccccgtgcttgcctctaagcttgtttaatcatatgctgtcctgcaatggaaatcagtgaatctttccaatactcaacccttttctcttcaagcaaaataattcgatgtcctcaaacccatataggaagtacattaccaatttttttgaatattctaacctctccagggagcatccgctggatgtgggtgtaaacaaagaaagcatacaggccagatcccactgcactgaggctctgactctgtcactccgaagaggagggggctctgcctttgtctgaagaataaacacttccattcttgtatcactgtttttcttttctgtatcccactcttaatgcagaagattctagaaatgggatcaagctggcattagccaaaatttctgacccctaatgtaccagaagatatcctcgtattaggtgagaactgatccatcaagaagcatttgtggctccctgctctgtgtaagacactgaactcggaggccctctcttcttctgcaaatagaccactgtaactgcagtcagcatttctagaaggtattgagatttggggaaatctctacctccttataaagttattggttccaatatttgtaccaagcaagtcacacacatcttttagatcaaataccttcagcagtatttttagctacagtaaaaacggaaggagctgggaatgatggtgtacccgtggttgagccccagagtataaaaactctctagagaatacgggcagctaaaaccttaatgttcagattctgacatgagccaatcacatttcaaataaacaattttcctcaccaacagctttattttactcagtgtttctgcacagcaaacctgcagctggctctggacagcagtggggagcctggtgcttgtcctgctcagccaggaagggcaggagctgcctggactcctggggccatggccaggactcattccagcccggcgaggttcagcacccaggttagccagatgctcaacaggggcaggtgctagacacccttttggaagaggagggactcttgctggtgtcagctaagaattgagagacagccttcattctgtcacttcagtaacacattcatcacaattctgaatctaggaaatttcacagatatccctgagggccccaatccttgatattctttaaagccaatgatctccctccatcattcctgcccctttctgttgtcaggcttggaaacaatgaggcgtgaacatctgatcatggccctaaaagagctgagagcctgggcaggggctgcggtgggaggggagctggaggaagtggcagctgactctgagtcggagcctgtcaatgtacacaagttagttcctgctgtgagaggctgtgcatagggaatagtgatgataatgaacatgaactatgtttttcaaaaacacttatctggaaaaagaagacaatgatcaactctacttgctacatcccttgaatccctgcatccaaggaacatcagttgcctgattttcttagaacatttaacaaatggcattatatggcagtaaaagcgaccagatctcaaagaaaccctctttttctgtaagaggaaggaggaggaccatcaatggcgataacgaaagatgacacattcccaaatctgttccattattaacgccagtgaggacaatctggcatgtcactgcagctgtttgtagaaaatggaacattttgcctttctaactgctgatttgttctaaacaataactgtattctgttttatacaagcaaggtggcaagtgggaagacaattgctaacgaatggtactaccctggacttttatcaacaaaacctctgtgtgttagcacttagggagctgcaacggtttcttaccagttaaactattcaaagctgcaagaaaaaggttatgttgaatgtaatcaccgttcaaggtttcagtgattctcattttatctgctccttaagggaatctaggatgtatccaggaactgtcaaactaaaaatactgccccgttgccctagaagaacccagaagctgcagttaaccaccatcaaggctgctcccctaagacaggaagcccagggccccatggcccccagtgctgagcgctgcgctctgctgagccacacagacagcaggagaggctgctgaacagaggtgcctgcagatgcgtcgatgctagtctttgcctgggcatactctgctgagctcttccgtctgactttccttgctacagaggtcctgaatagggaaaaacacagcaagtccatagcgccctccccacccctcaattgcggtgtgccctgtcagaaacagatgacattgctgggctctcgtttccgtactgtccagggcccaggagcagggcaggaccacaccccatttctgacacccacaaaagccagacttttttttttttttttttttttttttaaaagacagagtcttgctctgtcacccagactggagggcaatgttgtgatctcagctcagtgcagcttctgcctcccgggttcaagcgatcctcctgcctcagcctcccgagtggctggaatcacaggaatgcaccaccacgtctggctaatttttgtatttttttttgtagagagggggtttcaccatgttggccaggctagtctcagactcctcctgacctcaagtgatccacccgccttggcctcccaaagtgctgggattacaggtgtgcaccactgcgcctagacaaaagccagacttttgtggtcctacaattgcaggtggattttgataaccatcttgaaagttactacaatgtacaggcttcctaggtatctctgtctcaatctagaagtgaacctattatcatttaaagacaccaaggttgtagggcttttacagcatgatccatgtctgaaatgacacatgttatttaagaacagaggtgctgtcagtggtaaaatatgacatgccaggaaaaacattcttgatggcttttatattgctgattaatgaagccaaggaactaggttcaaattatgttctagaaactgtgctgggggacttctaacaccttctaacatttcagtctcattttagaagtcctagagattgagcaataaaatgcacactaatgacaaattctcatcaggacaagtgccccgcgggtgtcgagtaaggaataaagcaggtaagatgaatttcgaagagattctggtccttgaaagctagggctttgaaattcaagtcaatcatgaaaaaatgactgactagcctaagagtcatatacaacagtttctaattgaccttatttgtacccaaatccattttgatttgctctggtctttctagtctcacatttctgagcatcgcattagtcagccctgtccgccggccctccactacaccacccctgcagccaggtgcttgctgcgttgggcctatcatccccctaaatggactggcccacagcatacagtaacactatggactagccaatctggtgcttgagcagaattgaaaatagggtgattcaaattggcagaactctcggtgcctctc

SEQ ID NO: 472 - DNA, 53193 bp, Homo sapiens
aaacaaagataatagataatagattctgattttcaaatgcctatactgaagtcattctccaagtctttagccctgcagatcatgtgtatatgtacatatatatttaactttttatttttagataattatggagttgcaagacatgtacagggaagaaacgtacagggaagtcccatgtacacttgccccaacctcccccagtgtgaacatcttacaacgttagtacgatatccatgaagcttattcagacttcaccatttttacatgcacttgtgtgtacatgtactcatgtatgtggctttatgcaattttgtcatgtgtagccttgtataaccacagtaaagacatttggccattcccccaagactttctcatgttactctttacagccacatccatcccccatcccaaatccttggcaaccactgatctgtcctccagctctataattatataatttttattatttcactattgttatgtaaatagaatcatgcagtatgtatccttctgagactgactttaatcactccgtaacttccttgaggttcatccaagttgttgcatgtatcaacgtatcattcctttttattgctgagtaatattccatggtatgaatgtaccacagttttttattttttattcatttatttatttattttattttatttttgagttggagtctcggtctgttacccaggctggagtgcagtggcgcgatcttggctcactgcaagctccattcccaggttcacgccattctcctgccttagcctcctgagtagctggaactacaagtgcccaccaccacgcctggctaattttttgtatttttagtagagacagggtttcaccatgttagccaggatggtctcgatctcctgacctcatgatctgcctgccttggcctcccaaagtgctaggattacaggcgtgagccaccgcacccggccacagttttttaaactaccctttgaaggacattgggtagtttccaatttttgactattattaataaagtggctatgagcatccaggtacaaatttctgagtgaaagtaagtctttatttctctgggataaatgcccaagagtgcaattgctaagtcatatgacaagttcatttttagtttttttttgttttttttttgggacagaatatcactctgttgctcaggctggagtgcagtggtgcaatctcagctcattgcagcctctgcctcccaggttcaagcgattcttgtgcctcagccacctgagtagctggcattacaggcgcataccaccatgcctagctattttttttttttttttttagtagagacggggttttgccatgatgatgcctaggctggtcttgaactcctggattcaggtgatccacctgcctcagcctcccaaagtgctgggattatgggcgtgagccactgtgcccagcccatttttagttttaaaaggggcagccaaaccatttttccaaatcgcattacttatttttagagttttattatgactcaatccctagagagatattccactgtttgtttacctcttcctaattagagaagtatccttctaacgtcccacggagtcagatgaatgtggattcaaatcctgcttcactcacttattagctgggtgagcctgaacacacgtttaacttttctggagtctcagatttcctgtctgcaaaatagagataataatgcctgagacagtaaggatttaacaagatcaacatgtaaaataccgagagtagagcataaggaacatagtcaggagttaatgctagttctctcccccacttcatggcagaataatcagcaaccatcactatcaggtatatggtactggaaattttacctggctttaacaatgcaaggaaatgatactacttttattcatgttttttctactaagttttatgtgtgtgtgtgtttttttttttttgttttgaaacagaattttgctctgccgcccaggctggagtgcagtggcgcaatctcggctcactgcaacctccacctcccaggttcaagtgattctcatgcctcagcctcctgagtagctgggactacaggcgcctgccaccatgccccgctaatttttgtatttttagcagagacggggtttcactatgtttggccatgctggtctcaaactcccgacctcaagtgatccacctgcttcagcctcccaaagtgctgggaatacaggcatgagccaccccacctggctgtaaatcatctttagtaggtttgttatgcacagtgtttcctgggtaaaactagtttccctttcttcctattaatgacatgtgctgaagtaattcttaccactcttggaagcagaaacaagttggtgtctctgcattatattctgtttttgttttttttttcccttataggtcggtgaacaatttcctgatgactggtccaaaggtaagaacaaattccattaattgatatggatttcactaatcttagcctgttgactaaagatgataaatgcagatttttcattatatccacatattttattatgctgtatacattacagatagaaagattgagacccagagggtgttagggacacatctaaaaccacatagcaaaccactgtcagcgccaagataagaacgcaggagcactgaatttatggctagaatttccagagccataaaagtcaacagccttttataggtgtcaggctgcaaagtcacacatccttctcagtgccccgtggtgggatgcagtttcccatgtttaaaatgctggaattgtactacatgatctttacattcatgggcattttcagttccaaaatgttgttttctaagatggtcatgtgatgagaactccttaaatttcatgaattaggtgatttgggctcattttggagagacaggatagtatagtgaagaaaggtgaataaaggataatagggactagagtctgataaaactgagtttcatttctagttctgccatttgctagctctgggactttggggaaattactttagctcactccctgggcctcagtttcctaatctataatatagtgcctatttcacaagttatttgtgatgtcaaatgagacagcatatttaaaggcttactccattattttggagggatgggagagtgagcaggaagagggctgtttggtcagtttagggtaaatgcctcctaagttcagtctgaatttttacccctatgtccctacaggcttacctgatttactccagcagtgtggcagctggtgcccagagtggtattgaagaatgcaagtatcagtttgcctgggaccgctggaactgccctgagagagccctgcagctgtccagccatggtgggcttcgcagtggtaagaaaaacctcagccacagctccctggaccctctggtcacaggttagagccccagggatagccccttgcctcctcgacacccttattcctcacctgctctcttctcttaggtcatctccctctccaggatcttctcttttccttttctacttcctttttcccacctgtagagttttttctttctttctcaacactctcattgctcaacaaatggatcttgccttactcccaatcccataccatccttggcctcccagctggctaaaggtctcctcacaatgtaagtaatatcaggaggtaggcaggggtcataattcctcagacctcttagccccttcctcagcagagagatactgggcaagtggagagtgacttggagaccagattcccatggagaagataaagagtggccatgccagtaaatgaaagagctaccaatcagaggttcttttcaagactaactgcacatgactcttagaccctaagtgttccaggaggaagtggggatgggttctttacaacctagccttcagattcatctccctccccatttcttcctcaggctctttccagtcatgtgtgtcaacagtaccctagccacttggtcataaaatgtgtgacctgaaaagacaggaggtgagaagagcagggctaaggccagggatggggcagaccatgcaagagggtaagatacactataaagatgggaaggccaggcacagtggctcaagcctgtaatcccaagctctttgggaggacgaggtaggaagactgagcccagagtttgagacaagcctaggcaacatagtgagaccgactctctgcaaaaaaataaaagttaaaaaataataataaagatggggaaataggatggagctagggaaagaggatataatgatggttattaaagaaaggtagcatgtctggtatttctttaagctgaaacccctccctctaactctggatttttggttcctgctagccaatcgggagacagcatttgtgcatgccatcagttctgctggagtcatgtacaccctgactagaaactgcagccttggagattttgataactgtggctgtgatgactcccgcaacgggcaactgggtgagtagtaatgtagggatgggtaccataggccagccaacgcacataaagaatgaaaagcctggtgggggtgaagaagagctgtattcttctaaatatgaagaaaatcatgcggaagatgggtgaacgagtttgatcccaagccctacaatgacaagccaggctaaatgtagcttagaaccttcttttcccattgagtagtttccttaatttaaatataaaaataaagaaacaacactctggggattcctctgttgcttctctcaaacacaaggggaacttccttccgtgttgcctatccccgtctactttccactctttacctccagtgctgtctccaatctcctgagccctcctgaccaatttccaacatcgttgttccatatttcaattgtacccctctttccccctcaatgctcgagctttcctcatctttttggcaccattttgtcccttctggacctcaatcaccagcagggcacgtgcaccctctgcccatgcgaagaggcactgttggcagaggagtgtactggcaccttgcaaagaatccactcggcaactacttacgtcgttgagccctgagcaggggattggctgaacctggaagtgggcgtgtaaaagtggcaaaaacaaatctagacggcaactgatctggatacagggcactcgcccaaccttaatcctctcctatcctggacccccccacccccaacccaattagaaacagcagcccaggaggctctgcgcccgcttgctcaatgacctgtcctccctctgcacttttccagggggacaaggctggctgtggggaggctgcagtgacaatgtgggcttcggagaggcgatttccaagcagtttgtcgatgccctggaaacaggacaggatgcacgggcagccatgaacctgcacaacaacgaggctggccgcaaggtgagtcccgcagcccttggaaataggcagctgctggctatatccactaccagctccaggtgcggacaactcttcagttcatttaaaagattggcaaaatgaggtaccaagtgggctggcccagtagactaactagacttctcgcaactcccacaggggcagttaaactcgccacgcgcttaatccggggcctctcactcctagctctctccccaggcggtgaagggcaccatgaaacgcacgtgcaagtgccacggcgtgtctggcagctgcaccacgcagacctgttggctgcagctgcccgagttccgcgaggtgggcgcgcacctgaaggagaagtaccacgcagcactcaaggtggacctgctgcagggtgctggcaacagcgcggccggccgcggcgccatcgccgacacctttcgctccatctctacccgggagctggtgcacctggaggactccccggactactgcctggagaacaaaacgctagggctgctgggcaccgaaggccgagagtgcctaaggcgcgggcgggccctgggtcgctgggaacgccgcagctgccgccggctctgcggggactgcgggctggcggtggaggagcgccgggccgagaccgtgtccagctgcaactgcaagttccactggtgctgcgcagtccgctgcgagcagtgccgccggagggtcaccaagtacttctgtagccgcgcagagcggccgcgggggggcgctgcgcacaaacccgggagaaaaccctaagggtttcctctgccccctccttttcccactggttcttggcttcctttagagaccccggtaattgtggaacctagggaatggggaacccgctctcccagacctagggatcctgagagggagagactgcaatttctccaaagcttgccactttccagcctgtttccccaattcctctgtgctctcctagagctctgtctgaatcctcgcagccacacctaggtctgagaactcaggctttgagttactgatcttccttggattaggagaacaggtgttcctcctcccctctcctagcagccctaatgtctgacctagcctatcaagccttaggcgctggaagaacccttctcagacacgcaggacccaggtaaagtcaaagctttgcccttttgcccactgtctgctaccagggctcacccactgctgcacctctcttctgcacagctcctcccctgctacctgctgagccagattccccaggaatcttgaatgctttctctcctcttctccctttcctttcccagaaaaactgaggaaactggccccggaaaagcatgtctttggggttggttcctagaggcagaggttgaagatggaagagggagctctggagtgctaacttgaacaccaagggtgctactcatccctatggtatcatatcatgaatggactttactagtggggcaatgactttcctagacaataacccgagggactccagatacataccccgaaggtctaggaaatacgttaagggcagattacagtcatttcctaccctttaaaggtaacttctcccttctcctgacctacttcctcctagcaaccaactttacctcttcttctccaaaggatctttgttcctctgagccaagactgaggtaaataaagccactttcctcttcagatcctggtctgcacctctagaggcaggtcctaagaaggagaaactgagacccttccttctcactaacctggttctcaaacaggcaggattcagagcactggatatcttccttcaatgagtaaacttcctgcaatgaaactgttgcttagtaggaagttcagcaccttgaaccttaatttattgcagtcattgtgatatgtgctctttttctaggtactgcacttattcttgaggatattcgggtgggctgtggtaacagatacaacctgtaggctctctcctccctcccatcttggcaggataccatcctccctaaagcctcacttccctggtggcccaagcagttatctggattgaggctaagctgccaaggattagtaaatcatctatttaaatcttctaatacattcactcaagagccatgagcttgctgcttgtggtacttgagtcttctggttttattctcagagagtacagcagggacttgtttatgaaacagagcaagaccttggggagggaagaaccaatccctgacagaccctctgtagcccaaggggcttcccagccagcttccttgccctaggacagtcccaggtctggggctgggcagctcttctagagcagaactggtcagatgctagacgacctcaaccttcctctcccagagtaggaaaagcagtgtggctggctccaggcaacaaaagccaagactctaggggttcacctgtaagagtcaagggttcccgtattccaaactaaggcaatggccaggtcagatcccaaacccttggcctcacccacacaccttctggtcttaccaacacttactgaggagagagtttccccttcctgaccggggatacacttcctttcaggtgttcttagtgcttcatttccagctttctcagcaaaaggcccttcacgccttccctctgcttttatctgaacctcctgaatctcccaactcaccttttctccttaatcaagaagcagcatatactaacctacctgtcccactttgcagaattactttataatgtacacgaagaaagtttggcaaggcagctagaaaatttaaaagcacaatgttgtaaagtaaagctacattctccaggtctcttagcataaaagcagaactattgtgcttcatatttggtaactccaggtcagcactctaaatacgtcatgccgccagaacattatttcataggttattgttttatacccccaaatggataccagattcattccagttctaccaagaaaacatgactgagatgccttggatctgtattgcttttcccttccttttgcaatatccacttgttcatttgttcattcaacaaacaccagagtagagatagtggtgaacaaccaccattgctgcatcacggagtttaagttctcatcttacactcaattgccagggccgtggtccctttacaaagtagacaactccagaactggtgcttgggaagacatctttgaggtcagccagtcaaaccttttgtgttacagatttaaactgatgctgagaaagatgactggcttcttcccccaactagtaagttactgtggggagagtgcagagcacaggccccttccacctcttgtgtgctcttcaggagcccatctgtctcagccagaagacagaaacagagggaggccctgagaagtgacaaggacattggttggggtgggcaaaacactgtctccttcctgtccctggcctgtgagcctaaacacaggcagagctttttctttttgaaaagaatcgcagcctcaactggccttagcagcaggttagggcaaagacagagacggggtcgtcttcggcgctggtggtgctggcggtggtgggaggggagggcaggccagggcactcgcctattgtaggtctggattggatgcttccactcattcatttccttttaattaacccgcattcctggaggagaaatatttatgttggctcccatagaggcaatcctcagactggaaagaagggggaagaaagcctgtcttagcaaaacaatatctctaaagagctcaagaagagaaaataggagaacaaaatgccattaaaatagccttctacccccactggagtcaatgaaaacttcatttcacatgctaatccgccactccgcccccttgtcttctcacaacaccttttccgaaagtgtttgggaaaagtcttcgcagtcagtacacagctccctgcagctcagacttctccttgtgttagttcagggccccaagtggggctctcgctccagcagcggcttttttctcccccactttaatttaaacaaagacttcggagttcatcaacctcccactgaaattcacagctgctgaacaaactaatcccctctcccggcctttcttcccttcaatgggctcttggcttcaaagacactttgggaaaggactttgctagggctcacactgcttcatcaatagaagttagtgcaagtattatctgaagagcaagtggctttacaaacaaatactgcctaacaatccctccctcccaaacacacacacatctagcccgcagacatgatgggatctacaacaggattagggctagcatcccctggcttcacacccagtccctttgtatagctgagctcagccctgaagtggggtagggaaaaccctggaactgaacaccaggcacggatgaagggagacaatccccccaccctcaacacacccagcagagtgaccacaaatgctgcaaggagagaacctaattcagtgggaatggacaccttcctttaactttcttgatttatctctccctaagcctctcccctgccttactagggtgcaggaagcaagaataaagaggactagaaaggtaatggcaaaatagaacccagaggaggcaatgactgggagatgacagaggaaaccaaatcgaagcagctttattgcaccattaagtacatcactgcatcaaagacagtgccacaaatgcaaatccaatcggagaaggtagccctgagacatgtggtggctgcgagggagaaggacccccaacccttgaggagcagcgctggaagagaatcattccttaatatggctccaattccagaactgggctttatcatcacagaaggaatggccttgggctaaggctccaacataggtggagtcaagggcagttccccataggctgtggttcccctgctcctgtctcacagcctaagacagcttccagcaaaaggcagttcatccctttcaccttccatccaacctagcccacccttaataatgccggcagatgagaaattccattttaacagcgccaaagtttcctctcttggttctgctcagcacccatccctcacgtccatgagttgttcaaagggtgaacagcagtcagctctaccccagaccctgggctacagagaaatacggacctggaaataccaagtcagaggcagggaaaaggtaagggcaggctcataaaccacagaagggagaaacaaaagacccacatgatgggtcacagcagaggtaggcttaaaagtaacaatcctgttcaccctctcagaagccacttaaatagaagatccctgggggagaagatatcctgccccaggtccttacagagtgtagtattagggagagtgaagaactgattctatgccctgcctccaggcctgagagtgtcttggacagatcctagaaggccagacataaaggagtaaaaagcaggcactcagctggtttggagccaagcctacagcatcacatacctggcagcaaggaaaagagtcgggaaaaagaaacagaatctgttgcagaagtcccctcttctgcagggaggagttatgtaacagcagaagtggcctcctagcaagagaggctgcctggtttagaccagcagcttatgagcgatgatgaggacagccttcaggataggcatgaagctggacacctcgctgaagctgctacagcccgccacctgggcatgcactgcaaggccctgctcaaagcttcctgcatccacacatcgggcaacctcatggagcccagccacgacatgaggtgagagctgtggagggaatgacccttaggttagtgagcccaacccagctcctaccctggcagcatggaagggataagggaagacttaagttctggggcccagtccaggcaagatgcacgtattttgtggggaacccaggtcagtgacacctatgggaagaaaagacactgggcttcctttggccatggtgatggtggaagtgtaggaggcagtgggagcacagctagctgtacttactgtcccctcacagagcttctcatatagatactccagacgctgggctgcctcttccagcttcctttttgtcttctgcagggaaagaaatggattccaaccccagcccctaagtctaacaccacacagggccataaagaatcacagcatattaggccgggcatggtggctcacgcctgtaatcccagcaccttgggaggccaaggcgggtggatcatgaggtcaggagatggagaccatcctggctgacacggtgaaaccccgtctccattaaaaatacaaaaaattagccgggtatggaggtgggcacctgtagtcccagctactcgggaggctgaggcgggagaatggcttgaacccgggaggcagagcttgcagtgagccgagatcgcgccactgcactccagcctgggcgacaaagcgagactccatctcaaaaaaaaaaaaaaaaaaaaatcacagcatattagagctagaatggcttcatttcacagaggagggaatgaaggcccaagaagggtaagtgacttgctcaagccgacacagccagcaggggaatggcagacttcctcactcctggctccaccctccttccagtacccctgctgcctttaggtctcaatgctgctgggtcctaccaccaaggagctggacttcagaccagactcaaaagtctctccccagctccacatggacgtcaattaagtacaagatagagacagcatgtccaggggcagtgagaagagagtcacacaaggaactggtccacagctgaggggtcctggagccagcgaggggtgcgaggagggcactgtgaagaaggttcagacttactaagtcagttgcagacagggagcagcgttggagaagcgcctcaaagctgctcttcaaggactgatgctctgggggcagctccttcctttccatcttctcaggtggcaggtgctgaagctgctgataaagaagcagggagaaaggccagaggggcaagctgtccttctcatggcttccctaaggactagtccccagtgactcacagtcacactgttcccattacagcagagttggggagatgagcagcctccctttctctgcagtaaggacacctggtacctgcccccagtctccctcagcacatgccttgaggaatgaggcccatctaccatgacctgcacccaaggagggctggaaggtttcccaagggaggggaatacattgtccttgtcacctgcaggctgagttctcctggaactcctgggggagcatgactcacactggagacagggggctgtgagggaagaatcccttgtagctcaggggtgaggctcataactggagcagtaattggtgctgggggcataaatgtctctggcagctaaagagacagaaggaaagacatgagtctaacctgagagactccatggctctggttttggggagtggcaggaatgacagtgaacaaggagacagaagagtgagtgtgggaaactgggaagtgaggagactggtgtatgtgtgtaagagggaaagagaaagaagagggttctgaggaaagaagagtaagtgggaggagggcggggacagtctgagaaggggaaggactgactgaatcctccaaggaattagaacgtggtcattggtgaatgtgcgagggagtgggtagggaaagatgcattgaccttgttcctctggaggtttcccctgggggctggggcttctttccaggaatcttgaggtcctatagaataaaaagatagaggtttttcggcgcatagtgaaaaacactggaagttttttatctgaaggctggaagcattctttgagttggagttcaccatacctccctctgcagaccatctacactcccagccaccctccacccaacagggccctagccctctgacttgaggaaagactcccaaagtagtgagaggagcaggggaggcaataacccagaagagggatccatggaaggaagactgacctgggtgaggagtcaagatgccagtggttgggaggacactagagcatggggcacctgggtcccctggaaggtatggcacagggaagcttgcaggaggggctggggtgtgggagaccatgcggccgggacctagtggtctcagaggaagcagagggaacagtctaggagtctcaggcagggaggtagagccaggtcgcatgatgcctgggcatgccatgggtagaggggaaccaggaagaggccatgtcccagggaatcccaccgggttaggaacttgcaccctttgccctcctaatagctgtggctgagatgaagctgaagcagaacagaaataggtcatttgtcactaaacttcatttcaggagcaactcagagcatatcagggagaaacaggattgcaataaaaaaataataaatgattaatacatgtatatggaaatctataatttacaaaatacttttaactatattccttatttgaccttcaaaacaatcccatagcattgaaataagcaacacaacactttggtatattgccaaaggtacgaagccagtgatagcattaggaattcagacttcaacttccaagctcctctcactagacagacatacagcttcccaaatccatgctggccatgccaattgctttcctgagacctctgtgctctgcccagatagatcttcagtgactcactcaccaggccttaccccagggctcaaaggcaaaggctggatggcctggggcccaggtgccctgtagtcacttatattctgtgtcctgggaccctgataagggctaggatgggaaggtgccaagggcatcgctggtgatgactgaggggtgaaaacccttggccttggagatggagttgggacctatgaagagaaaaaaacatcagctcttggaaaggaaagagaaaggtaaataatagaaaacagaaaaataatagggaaaattaatgaaacaaaaactagttctttgaggaaaaaaatcaataaaattgataaacatctaaaaactgataaagataaaaagcaagaagatataaatcatcatcagagatgaaacagggactattacaacagaccctgaagccattaaaaatataaacgaatactacagaaaactttacattcataaatctgacaacttatcagaaatggacccattcctcaagaaccataaactaccaaaactcagtcacaatgaaagaagatctggatagtcctataaccattaaagaaattgagtttgtaatttaaaagctcccaaaaaagaaatctccaggcctagatggtttcactggagaatttcaccagtcaaagaattaatgcaaagtttatgtaatctcttccagaaaatagaaggaacacttcctaactaatttcatgaggccagtattaccctgatgccagcaacagaaaaagatagcagaaaataaaactacacatcaatatttctcatgaacttagacacaaaaatcctcaacaaaattttagcaaatcaaataatgtatataaaaaataatattccacaagaaagtgggattgattccaggtcatacaaagctgatccaagatatttaaaaaccaatcaatttaatcccctataccaacaaactaaagaatgaaaataacatgatgacagaaatgatgcagaaaaaacatttgacaaaattcaacaccgattcatgatctagtacacaaggtgttatggtctgaatatgctccccaaagtcatgtgttgaaaactgaatcctcaatgcaacagtgttgggaaagtgggactttttgtaagtgtttaggtcatgagggctctgccctcattaatggattaatgccactacaaaaatgacttgcaggagtgggtttgctttctcttgcacatctgctatctgccatgtgagaacacagcagcaaggcaccatcttgcaactagagggtggaaccgtacctgctggaaccatacctgctggtgccttgatcttggactccagaaccataagaaataaatttctgttctttataaatttcccagtctgtggtattctgttatagtggcacaaaatggattaagacacaaggaatagagggaaatgtccttggtctcataaagagcatctgtgaaaaacctaaagctaacatcatgcttaatgctgaaatattgaatgtttttcctctaagactggaaacaaggcaagaacattcatgttcactatttatttattttttttgagacagagtttcgctcttggtgcccaggctggagtgcaatggcacaatctcagctcactgcaacctccacctcccgggttcaagcgactctccagccttgcctcctgagtagctgggattacaggcatgcgccaccatgcccggttaattttatatttttagtagagatggggtctcaccatgttggccaggctggtctcaactcctgaccttaggtgatccacccacctcagtttcccaaagtgctgggattacaggtatgagccacagcgcctggcttatgttcactattcttatttaacagagactggaagtcctagtcactacaataaggcataagaaagaaattaaatgcatatagattgaaaagaaagaaaactatctatttgcagatttgtagacagcatgactgtctattagaaaaccccatggaatccacaaaaaacttctataactattcaggaaagtcacaggatataaccagatcaacacataaaaatcaactgcatttctatatactcacaatgaacaagtggaaaccaagaaatttgattttaaactgctgaagaaaaaaattaaatacttagtaggcatgagctgacaggtgatataaaaaattaaatacttaagtatgaattggacaaaatatgtacaggattggtgtgacaaaaattataaaacgctgatggagaaacatgccacattcatggactgaaagactgaacctagtaaagatgtcagttaggaacttgtatttgaatactcatagcagctttactcataataccccaaattggaaactatccgaatgtccttcaaagtttgaatggctaaaaaaattaaaactggggccgggcgcggtggctcatgcctataatcccagcgctttgggaggccgaggcgggcggatcacgaggtcgggagatcaagaccatcctggctaacatggtgaaaccccatctccactaaaaatacaaaaaattatccgggcgtggtggcgggcgcctgtagtacaagctactcgggaggctgaggcaggagaatggcgtgaacctgggaggcagagcttgcagtgagccaagatcgcgccactgcactccagcctgggcaacaaagcaagactccatctcaaaaaaaaaaaaaattaaaaccatggtacattcacaccatggaatactactctgcaataagaatgagtgaactactggtacacagaacaacttgaatgaacctcaaagaagttatgctaagggagaaaagccaatctcaaaaggatacatattgccatgattctatttaagtaacaatcgttaaataacaatgatagagctggagaacatattggtgaagccaaggatgagggaggcagaataagtgcagctataaaagaggtaacacaagagagtcttgtggtgatggtaaaattgagtatcttgattttggtggtggttacacaccacaatgtgacaaaactgcataaacacacataaacacacacctaacaatatgtaaaactggtggagactgaatctgaaatctgaatccatggattgtactaatggcaatttcttggttttgatagcgtactgtggttgtgtgagatgccgacacggggcggggtgttgttgggatgcaggagacatcccagtacatttctttgccacctcctgtgaatctatggttatttttaaatgaaaagagacggggagagggagagagagaggagaggaggggaaggggaaaaggggagacaagggagggaagaaagggagggaggaaagggagggaaaaaaagaaaaggaattagggtggggattgaaggtgggacaagatgagccatcagagcttctgcctggtaactgtatccaaatctccctggattctgttctccggcagctctagcaagcttctggcctcacatcttaacagtatccaatccccccgggcactttggccagaacctctttcctctccctcagtacccccaaccacacacacacctctccaaactatcagcaattctgtcagttctatctactaagtactaagtatttcaaatccaacctcactggctagctttagttatttcatgtcttcatcatcccttactatagcctaactccctccagcctggcccttcctaacatacagctaattatgtcactcttcctaaaactgttcaatagctcctccctgtcaagtttaagttctttagcacagaatgctaggtccttagtgatctaactcctacctgttgttccagcttcatctaacttcacagccacaaacacctgtgttgcagccccaattaaataatagtaattctcaaaaggcttcggcttactcttgcttcagtgcctttgtacatgctattctctgtgcctgaaacagtcttcacttgctcatccctttgcctaaaaccttttaatctttgaaactctgatcaaacatccgacttgttctgaaacactccctggactgcccccacaacctcaccatacagagtaaactactttcatctgtgtgatcttatagccccttgccataccccaatcatggtatttatgaattttactgtagctatttttttttttttttttttgagacggagtctcgctccgttgccaggctggagtgcagtggtatgatctgggctcacttcaacctccacctcccaggttcaagtgatactcctgcctcagcctcccgagtagctgggactacaggcacgtgccaccatgcccagatcattattttgtattttcagtagagatggggtttcaccatgttggctaggatggtctcgaactccaaacctcatgatctgcccgctttggcctcccaaagtgctgggattacaggcgtgagccaccacgccaggcctactgtagctattttttacatatctatctttcgactacactatgagctacttgagggcaagtatcacaatttttgcacctttatgtcctaagagcctagtagttcaataaacagttatttattataaaaagaactgaatctatgttctatggaagttgggaattttcatcagttttgttcacaatatattccaagtgcccagaaccatgcttggcacgtattattgaatgaacaaatgaatgaacaaacgaggtcttacctggtgagaaggctgggatcccaatctgtaagatgatgtctctttagagtggagggtagctcccacaacaatccgggggaaggggaaagggggagactgttggcccaagacagcagaaccttgagcatgaaaaagccgatctcttagctgctgaactggtggctataagttttaatgaggaagagctgtgtcaagaaattaaaacaatcaaggccccaggtagcagtcaaatttcagctgaccctctacaccaagcttgtccaacctgtgttattttgttgttgttgttgttctgttctgttttgttttgttttaggtttttagcagcctgaagccatggtttttggtttgtctctagtgataagtggaaaaccgggatgaggaaggggctttactggcccaaccagaaacagaaactaagcacccacgactgtattctgacccttggacacccccgctctatactctagcccccttagagatgactcaaggttcctgaatccctgccaaacacttgcatgcctccctccttgctattctttctgcttagaatgctctatatctgctggtaagctacttctctttgaaggtccagctcagctgttttaaccattgagaagccttccttgacttctccaggcaaaaatcagtcccttccctggactcccacagtgctcagtataagcttctgttatggcactataagtcatcaacatctgatcttcccccagtagattgtgaggtgcttaagggattccatcttatctatcctaggagcttcagcattagcatagtgcctggaatatggaagtgctcaatcaatgttagatgactgaatgaaatggtttgctctctccacatggccccacttacctgagcacagtccctgggtagaaagctcatggcagtggccaggctgccctgggctgccaggaggttggcatactgagtgaccctgtaggttgtggcagggcctgggctcaccccatgaggaccccgcagttgctccaagctcctgttaagaaccatcaccttctccatcaggtcctgtaagggcaaggatgagggtggtaagccttcaatgaggcatatcctgctctctaagtccacgcagctcattcagggatctcccactatgggtacagatgagggcacctgaccatacctaggtgaaggcagcagatgatgacacgtaagaactgtgacagagaagggccacctggcctcacctcccaagctgttaggattggatttaactggacccatctgggtcttagatttttgtacatctctacctcttccttttgcttttttaccctttctgcttatacatcaccaaccacagactctgtcagactaattgtttcatgtgcgacttttgtctctccatgagtctgtgacccccactttctgtggtcacccacagaacacctggaagtttagatccacagaactttccacagtagctaatagaagggccaagccacaattactcaagtactgaatacatctgtaaaaccaaacctgaaataggaaaaaaattatgaagactaacactgaagcagctgctgcttagtcttctctgagggaagaggagaagatcccagacattcaggacctttcgctcctccctaacaccgtggttccagcctgtcccagaagattcgcctctgctagctctgcacatctccaccactagcctcctaagggcctggtgtggagtggccagtaccctgcagagaaggggtacctgcagagccatgggggacaaagcctggtggcattttgcccagcactccaccagccgctccacactccctgagcacacataacagagtctggcttcggaggttagtgccctgctgccctcctgttccatgcgagttcccagcatgtctgcagagagagggtaatttcattaatggcacagctgccctgtgtgcctctccttctcctgtttggaaacagggagaggaccatgagcctgggacaagtagctgcagtttaagacaacactgagactcaccttgctgtacagagaaggggaaagttctcacatcatggtgtgacaagacaaggtaaaacaggacaacaaaggatcccctctgaaaataggggcatgcactgtggtccctgcctcctggctgagccagattctagccctgacaacattgcctcgcctcccacagctcagtctgctcctccacctccctcctgcatgcatcctttgactccatgctggagtcacaccatttcatcctgaagcctgggaccacacttaccacagagctcgggaaatttctctgtgcctgagtatgtcagtagcaaagccagtgcctctctccagttcttcaggctacaggtacacaccacatccttccaattcttttgcacaacacaggctagaagctgtaatgggcagagagggaaagagaccatcagccatccatccagcataggcagcaggattcctgcacaggcctcctgttagagcactgagtaggggcaagggatgaggtgggggtggttagagtagaaagagagaggcaggcagatactcaaacatgggtcccaaggtgtgggtatccacctcacaaggtccaagtaatcccctcccttcttctcctgcatgatgggcagttaccgaggagattttggttttcttcttggccaagtagcgctcctgtgtttgcttcagcagatctgtacccccagcctgggccaggataatggcatcagcaaagcgctcctccttcagacacagctccacggccggacccagttccccaagcaggagagcctggcttaggagtccatcaatatctgcaggcagaagcatcccctgtgcattagttgctctcaaaccccaacttcctgccccctgcagggcccacagcacaccctctatatctctatatcactcagtgtgcttggctccaaactaaatcctcaagtttcactccttggcaataaaatgtattttggtgcccaggtctaaagacagggcccaagacaagggagggaactgatgtggcagtagcacagtgtgaggtgtgcttgatcacagtgggcagggccacagtcctttcagcaagaaggatagaagaaaatctgttggtagaaggccttccataggaaggacgtatccatgaaaatctacaaccagagagagctctaactggtaagcgactcactcagcatttgagacggtgggaggaaggcacgaggcaggggacaagaagggaatgtctcaagtccaaaacctccgtgcccacctagtcctaagcagagactctccctctccctcagggtcagggtaccttttgtgatggggatctcccaaggagtcatgttctgagggaccagctcatcaaagaaggctgaggaagcagaggcttcctttgtggtgtgtttggaggcctgtatgaggaaggacagaggtgactacttagggatgaacccaagacagacagagagctggcttagtagccctgagagctctactatttggccgttaatgggtaaaactaaaaaaatagccaggtaaggtttggggagggccatagttcatggttaagacacagctctccactcccagcccaaaagcttagggactctgtgtctcactctggttctaagagagtgaggagtctgaagacttctacagacgctaaacacttacagacagcaaagaaaagggccaggaagggaaagatgcccaaaaggcaggtttcctgtgttaccataggtcaggctgactggactcctaccacacctggctgcagaaggcctgttgtctgtcactgttgaggtcatttcccttgggctgaggactctcacctagccccacgtcactcttcaaccatgtggccacctgcagggagagacctctgaaaaccgctctttcaagcgtaagatcaaataagcattatcctcttttcctatctccataccccaccaactgtactctctaagatccctgatctatttttttctgagaaaaaaacaaactccaggatgtaaaatgctcacatatgcaataataaggccaggaagaggtattctgaggtggtttactctggcaacattctcttcttctcttcaacaagtacatgtttctgatgtgaaaagcagcttaccttcttctgaagctcatctttactgtatcctaaaagctttaggaatttcattctggagtcttgctctaaggtcacctaagaaaccacagaacacagaaaagattccattaaatgaacataaatgacgctcttcctacaacaagctgggtatctgtgccagtatacccaatatagttctttgtactactagaagtgccctcagcagtccaatgccatctctttttcctccctggatctgacttactgatgggctatcagcagtgttaacatagccccctgccctttgcacatgagaatttgacctttcattgacttcctagctctgttaccctggtagtctggtgagagtaaaatgtcagctgttcctaggcaatatgcttgtgattggtaacttgcatctggactggaactatgtaacctagaaataattaatgtgaacaacatgctatgcatttccctgtttgcagtggctcttgtaactggacagattccttgcagggactccggaagctatgcttttagaattggtacaagagatattggctcttgtgggcaagaagcttctaagtcagggcaacttacatacctgcctgatgtatagtctcatctccttgcacctgagctgtctctggcgggctgaagaagagaactctgaattactgcatgactgctgaaagggctcccacagaagacacctgcctgatgctaccctgctgtggtccctatcccatatccttccgaggagactgctgccaagtgtagcctacagtagtcttgtgagtctaaatgtttcttttcttttttttttttagacagactcttgctgtctcaaccaggctggagtacagtggcgccatgtcggctcactgcaacctccaccctcagggttcaagtgattctcctgtctcagcctcctaagtagctggaattacaggcgccctcaaccacgcccggctaattttttgtatttttagtagagacagggtttcaccatgttggccaggctggtctcgaactcctgaccccaggtgatccacccacctcagcctcccaaattgctgggattacaggcgtgagccaccgcacccagccttgtgagtctaaatgtttctttgagaagacctctggtagaagttgcacaggtacagtaaacaaagtcagcttcccactcaatgtcccaaataccaaggagcaaacctttctgaagcccccgtaatcttggttagctgtcccaggcccttaatttattccacactgaaacatgatttctaaccatacctttctcatagtctctctgggcacccttctccttccatgcccttcccttggaaatgttcaccacacccaaccaggaaccatcatgatggacagctcttgggtagcttttaaaccagaatgcctggccaggcgcggtggctcacgcctataatgccagcactttgggaggctgaggtgggtggatcacctgagttcaggagttcgagactagcctggccaacatggtgaaaccctgtctctactacaaaaaaaatacaaaaaatacaaaaaaaaaaaaaccctgtctctaaaaaaaaatacaggcgtggtggcaggtgcctgtaatcccagctatttaggaggctgaggcaggagaattgcttgaacccgggaggcagaagttgcagtaagccaagatcatgccattgtactccagcctgagcgacaagagtgaaactctgtctcaaaaaaacaaaaacaaaaaaacccagaatgccctgtcctataggtccctctgtcctataggtaccactgtctcctttgtttagcggagtaaaggctgaactcctgaccactccctctctttaccatctcaccattcctggaacttgtatcctgcttatgacaaaagcatcatttcttattcttttcttcccacatcattctctggcttcactgtatagtcaagatctttctcaaatcctctttctctaacttcctgatgtccaccttcataaagctctactatgcctaaagctcaaatttcaagtccctctcagatgccctggtacaggcccaatcctttttgctttcttctaaacaattccaaaaacttgcacaatcatcccactgactgaccagtcagctacttgcctttcttccttcagatctctcacttgctcatttcctttgataggtatagtactcctcctggtgtcacaggaaacttgaaattaaatgagaactggaactgaacccatgcctccagtgtacagtggcacctgaaccctaggacccactccaaggacttgccttgggttacttgaaaccaactcaaagccttcttatgacaatatgtccttctaactaatgtttttcctttctcctctttttctctttcctcccttttttcttccttcccattaccttatctgccctttggcatgataccgtgaaggtctttgccttggccctggtaaaatacctaggacatcaaccatagtagcaacaaaagaaaacatctcgtgtattccccatctttcctagcctcttcccaaatggcctttgagcctctggtaaagggtgaacgttttgtgtctagatggtgggtatagtgtgggggaaaaactaatgggagttaaggcctctgtgatctgggtcccagtgtgcttgtgcttctcctgcagttgacagaggttggagttccaggctttggggagacacttctgagcagctagccttcaggcttcccaccttcaggaactgccacagcatcttttcactttgcagtaaagcttgctggctcttgttctgacagtaattcagtagatttcctgatcccaaggcctcctgcagctcagctgatcgcatcaggaattcagattctgtggtgacttgactgatgaagactaggcgggggcaaggctgtggcaccagatgggcaggggtgctggggaggccaaaagtaaccagcttccctccaaactggtgaggaaaagcaagaagggtaaaggttataccttcaagtcaaaaagtaacactaagtcagattcacagagaaggctatctaatggctgaccctaggctaggaaataaataaaataagagagttcctggggggtggaataggatcaggaatttagtattgaattcgtctccctaccaaaaccacttctgcactcttaggaccacccacttcaaacttcaccacacaagactcaccttctgctaacctgtcctggtaccaccattctcccagtcacctgggctaaatacctcagcattagcaaagtcttcataccccctatagccaagcaacgacaaagtcctacctattcttgttcactgtctttcatgcaggtcccctccatcccattcccagtgccagtacccccagattactaaaatagtttgctagccttctgttcttttccctcctctaattaagccttagactatccctctattgcttgtaccaacctgctgctattcaggagcctgtgtggtttcacaaggccacaggaaagagcttaagctccccttcctgcagtgcacaaacctctgcaaaatcagggccaaacctatctttcccagcatctctctccctgcttgtttattataattgctccacatccctaaaatgcctggtgtgttcctgcttctgtgcctttacccacaacacccccacctggagtatccgtctcaccaaattagatgccttatataaagcatctggcacaaaacaggaccttagaaaaaccctttttactccagcagttctcaacattggctgcatattaaaaccacatggagaacaatccagacttgccaggccacaccccagacaatacaatcagaaactctggggatgggactaggcatcagtattttttgaattattcaggttattccaatgtgtatccaaggctgacaacttttttttttttttttgagatggagttttgttcttgttgcccaggctggagtataatggcgcaatctcggctcaccgtaacctccgcctcccaggttcactcgattctcctgcctcagcctcccaagtagctgggattacaggtatgcaccaccacgcccggctaattttgtatttttagtagagacaggggtttctccatgttggtcaggctggtctcgaactccccgacctcaggtgatccacctgcctcggcctcccaaagtgctgggattacaggagtaagccaccagcgcctggccgacaacttttttttttttttaatttttactttaggttaaaaaaattcaatccaatgcagtaaatgtccatgtttgttatatggtaaacttgtgtcatgggggtttgttgtacagattatttggcgttgataactattgctttactccctaactattcaccatttcttttcccaatatccacctcctaatgaactctcccagtcagaattcttatttaccgtgacttctgcagcacaaaatctacaccacagattagtgctaaacaaaaccattttaacttttgatttatatagtacttgatagttttacaaagtgtgtacatatattcttatttgtggttcatgttaattttctgggcaggcatcactatccctgttttaccgataagaacggttaagtcctgagaggttaaatgaattgttcaaggttacccagctaataaatgacagagctatgataagaattcaggcctcttgacctcagaattctttacctccctacttctttttctttttaagctcacagcctattgaatgtgttagtcttgcctccccagtaaaaccgttggctttgaaaacaagaacttccgcttttatacatctgttttcaattcaaacctaatatttaaagcattgtaccaagtgcttcagggccttgtcattcaaagtgctagtcctccgaccagctgcaaggacatcaactgggagcctgctgaaaaatcagaatcttgggccttacttccaactcaatgaaccagtttctgaattttaataagatccccaagtgatgtggatgcacattaatagtttgtgaagcaccgctttggggatataaaaatcagcaagacatagtccctatccttaaggagtctattacttagtagggtaatatgcatatatgtatataaataactttagtatagttagaatgtatcgttaccaaagtataagtctgtgggattatagagagaggttaattttgacttgggttaaagacaggcatcaaggaggagatagtatttaagagaggggccttgaaaggctgtggtagcattcaatgggcccaggagagaagctgaaggttagggtacaagcagagacaggaagagttgaggagttatttacaaaacagaaagaagtcatatgtaactggaacatagagaacatatgagaatgagacagaaatggaaaggtaagtggagccctgtgcaaatttagccttgtctataaagcaatgggaggctcaaacgttttgaacagagaaatgacagaataaaatggttttttttttgccttctttgtagttccttactaccagtccagacacgtaagggttagagaaaagatggaatctcaggctatttctccacaaccaagagttctaaggcagtcagctccttttagacaggactggcagaagatatagaatgggtgaagtgaagagaaggaagctatagtaactctctccttgagaggtaaagtgggatccattctgagacagaggcagtgggaatacgtctgctacaaaacttagctccatgctgggcacatggtaggcttcacaaacacacacacacacacacacacacacaaacacacacacacctatacatccactacacttacagcaaatgaaacacctgttggtcttctaatccatttggggggttttttcaggggaggtatcagtggtgcttgtgccacttgctctggcacctgcagtggtgggagaggctggcctttgctgaaggaagaggagatctggggggaaaagacacctgcatcgccatcctaaagtggcagtttagtcaggaactccacctacaaactccattttgggaggaatccttgagacacccaatttgacctagaaaggtcagactcccatattccaggggatggggaagtgagtggtagcgagggtgggactcccatgcaagtaggctcttggaaagactactacattcaaagtctacaatggagtgtggcacaaaatggatctatagaagagagaaagataagagtcatactcttgaaataactgtcccagcaaaggggtcccacggtccctgaaatactacagggcccatccaataacaagagtcaaggtgaaggccttcttcacattgtggcagaaactaacatcctttcaggaagatgggcactagggcaaaggtgcagccctcccaaaccccgggccctggtctcccaatctccaatatctccgcttctcaagccatatgtctctctcccacaaacagagacagccccttccctccagcattctctaccaagcccttcaaaccttgtcagcctgtctcatatgctggacttcccagctcctacccatcacagagtacaaactgatccagccgttgaaggaggcagcagagaacactgaagggtcccgagggcaccactgcacatcaaagcaccagctgctctgtgttggtagcttatataccacctaatatgagggaacacaccattagggacagtccatgaaacccaaaacacatggctgcagctgagattcttctaccctctctctcccatcccagcatgcccacagaagggccagcctacctcactgctccccaggttccggcacaagatctggctgtccttagcactagtgagcagcagctcagcatcagcctggctccatgacactgacaagatccccctaaaaagagaagggaagaggaactagcatttgttgaatgcctactatgagtagggtgccttatatgtcttttatacattttatagggcatatcagaccatccatgccctataaaatgcatggtctgatattatcttacaaatgaataaaatgaggttttgaaaaattaagtaactttccaacagttgcagagtcagaacccaaaccaaacctcagagcctgtgcactatgcaatgtaccactctgcctctcttagatcactgcaggatgacctgcttcttttcactgattagacagtagagattatgaatcagtatgaatcacacaaacactcatcactatgggtgcttttagcccaggaggtagtaaagacctaaccatctaaagtccccaaggaggccaggcacagtggctcatgcttgtaatcccaacactgtgcaaggccgagcggggaggatcacttgagcccaggagatcgaggtcacagtgagccttgatcacgctactgcactccagcctgggtgacagagcaagaactggtctaaaaaaataaaggtacccaaggagatacaaaggcaccatggccctttggttagaaagaagagattgtggaggctggatagaggcctccacaggatagacaggagtcaagttgtttttatgaagaaatcctggaggaggcaagctcatcacctaaagaaatgaacattatcctcatatcagagcctggaggctaaacactggttccagtatttctcattaccccattccattcccatctctggaatttagatggaatctcagcctcctctccataacctcagggtctaagggcctcctcttggttaaggctggagtaggtattgggtgactatatgttgaccggaatggctttaaagccagggaggatgtttagtagctaaagtgagggatacattgcctcctacccagcccagttatatccaccatccccccaaggatatggatgacgtctgagatgctacctgctgtggctctccagcaccttcaagggcgaggaggcaaagcgcaagtcccacagctgaatcacgggaagtcgatcatcctctgagcacagcactaactgggtggctatgtcaggatgccaggccaggcctgagcagtgcatctgtgaacaaagcagatcccaatgggtgctgtaacctgactcttttgcccagttgaaatgggaccactctgagagcaagttttctgtctcttttgtgactgggaacaccacaggcatcagagagtgatggccaggaataagtaaggaatggcagaagcttccagatcagctctgtttagcttccctaagttttcactctcaataggaaatgtgctaagcggctgactccacatgtccgacagctgaaagcaggactctggcctggggcagagcagctctaactgctaggcaggagagagaagccagagcccaagcctgtgttctggcctccaatactcaccctgttgctgtgatcactgactttgatgataggttcattcttcctgagatcccacacaactgccttgccactggggtgagcagaagacagaatgtgttgggcttgccggttccaagacagtgccttgatgtcctctggaggctgctaaggcaggatggggacagaaagatgacaacttgtcaccccctggacaaagtgacatctgctgttccactgctcccagccacccacagcaagtccaagaatagacatggggctacccaaactaagacagtgttgcgaagctgggagttgaattttccagggaggatcctttagggtatcagtgtagaagcagaggggatggcaggcacatctaagttttactcctacccaaggttttactaagaggatagagtcaagattttaaaaaacagccctcttgtctaggacaaaaaaagagggagagaaggaggaagatgagggagggaggaaaacagatacccaagaccccaagagagagtgaggccgagagaaaaaccacaagatgctatcaaattgaaacttaacttacctcatgatactgtaagcacagaagaaagagaaaaggccaggaagcaaaaagatgggcccagttacagattgacagacagcctctccaagacagaagaccagacccccaactgcatggcagagccacatacagggagaacaaagctgacccccccctccataaaaaggacaatggtatgtctggggtcctactcttcctccctctttgctgggcccaatgccctacccaaccctgcgaaagctctactgtgataaacagcactcccatcccttcttgtggtgtcttttgctctccccaactttcatctgcctcccagaaactcttagaacgagtaatgagcacaaaccaactaccccatatacaccctccacccaccagccatcctaactcttatctggctggtagcatgttagtctgtggagctttattgccctccagtggtaaagtttgatatctcttgagctctgattggctccagaactcaagacttttacttaggagaatcagctgcacactccagggttgggtagtgggggtgctgctcacctgtgacttggatcccagggtcattggcacattcaagttattcagatcccaaatgaagatttcagaatcgctggcccctgaagccaggaggttgccctgtatgaataaaaagtgtttggagacataccaccctaggaagaaacagagcaagaaaggaggaaagaagcccaaatttggggctatcaaaagcctcccctgaaacagcctggaaaggggtcagagttacagactggaggccacaaatgaatgcttccactcagatctgttgctccctggcttggccatgtttgactaactgaaatgtagtacctggaaaggattcaagtcgagggctctgacagcccccgtgtgcttctgtttctgagcaatcacaggctccttccccgaagacaggatgtgggtcacattgtatagaataagcatgccattgtccccgccgccaacaataaccccggagctttccagaagcccactgccaaagctcccccagaccagcttgtgaaacctataaagaggaggaactggcatcagtacaaacttaggttcatgtcagtaagcacaggatgggcatctctgtcagcttctgccattatgcaggcagccccacccctagctggaacttgcctgtctccttcatttcccagacagaagggatgtatcctccgcccagtcctgccctttctctgaaaaaatgtttcatctacgttacaccagaagccaggaagccactgcctctgagttgtgtggaggtgtatatatatacatatatatgtacatttttaagttaacattggggttatataggctggtgatatatacttcaaatagattacttcacataatcctcacaactcaaatagtcaggtaataatagcaaccacttacactgactgaatacttgctatgtatcagacactgttttaagtgctctaggtgtattagctgtctgaacatttaacaacctcatgaagtattactattatttccattttcaattgagaaaactgaggcacaaagaagttataaaatttctatacacagaggtagtaattttatccccattttaggataaatgctaggaagtagcagggtcaaggttcaaagtcaggcccatcttattccagagcctgagctcttaacatcataaaatactgtctcctattgagagaaagattcaaactcttctgtaactattagaagcaggctccctagaccaacaattcactctcaaactggaaatgagaaaagacccaatggcctccccaccccatgcctctcccatgtggctggcccactggagtggccatgtggctgcaaagggccagacctggagacagaggcatgaaaggatacactcccactcaggaaatacttttctggatttctgaggatgcttctaacaagataatgccaatgtcttgccccagagaaaaagatccctttggatccctggatcccttctagacaagtttgggtcctctgcaaagcccctacggaagacatgtgaaatccctgaagcctcataggtggtctgtctctcacttcatagctgctagccaaggacatttccacagccctttggagaagccagatatcacgccaaatgaggttacaagatctccaactgcaaagaaatattccctgcgaacagtcagcaaagcaactgagtaggtgataggcaggaacttgttaggccagtcactggagcagagccaactggtcagaagcaaagtatggagaaccagctcagaccaggtcagcatctgaagcaaaacagcagagccaacacaatgctagctaagaggctactgccagaaaggctgttttctaaggttgcaatgatcttaatacagcagaaggatgtttttccatacaggctgaagaggctgccatgtcatccagggactggagctcagcaggggtagagggcatgtcaactgagtagctagagaagcccacagtaggtcacacaggaaccagcggagggtatgtgcagtgaaaaacccacatgaagatgcagagggtgcagcgacctcagcatggtcggaacacatgacatacagagcacagtaaaaggtacctgagacctcaagggggagtcaccaaagggctggaaaagagggcagttacttcagagtggcagttacttcagtttgccacatacagggtgtgacaaaatgattttctttctgtatgcatatagaaagcacatttctgtggttaaccacatcactagcaagggtaaagctggcgcctgaataggttgtgatagagagcaaacctgggcgaatgggcttaacacctaggtggagttaagtgaggaaggagacttgatggttcagggtgctcagggagtgttcccatctctactctgcaaatgaaaacgggaacaagagatgggtgggtgcgtactattctgcaactttcctgtaagtttggatttttaaaaaataagaagttgaaaaacaaaaagggtggtctagctgggcacagtggctcacacctataatcccagctactcaggaggctggggcaggaggatcacttgtgcccaggagatggaagccagcctggtcaataaagtgagaccctatgtctatttttttaaaaaagaaagaaatatctgctgtataaattgtttccatgatttattcattcctttggtttggattatttcattttcttagtaagattcttttcaaaaaaaatcctagcttcatgttagtgaactaaagtgaaaagagtttgtccacattcaagccaaaataacttgggaaactcaagcctccctagaagtcaaacagagtgattaaggcagtactccaagctggagaatgaatggagcattggttgtttgagaggaaagctacttttctgaatgcctacgcatctactatgaatcctcaatttacagtgggaaaaaaaggttcagagaagttaaagtgtccaagaggacagcaagtagcagagctgggatataaactcaggtctatccaacaactaacccatgctctattatcttaatgcctctagaaagaaggcaagtcttgagaacaggaaaactgagagaagtacacaaatgatttttttctgcttgatgttgtcccttacagaaggcccccaaagagaggacacagtgctccccaagtaactagaattgagataaaggtagaatgacagaagacagatcctctactttctccatgttacttgaggatggttcttccagaggttatgggggccactccagagagctagaaactcagtgtatagagagggtaaggtacagcagaccacacattgatctctcacctcatttacccacagcagctatgtcctcagtcgatgatataaacagtgtgatattctcccagaaacctttctttttgagtgaaattcatctaacaaacccaacactgtttgcttcactgcacatgttaatccatattgattctgactgcatccagaggcatttatccatgcactctcttcagtctatttatagcttgaggctgtcccttatctatacccatactggtgtttcagaacatttttctttcagtcaaatatttctaggtagataatatttctctgatgcatcaaagattgaggataaggggatcttcaggatccaaatttggttgaggcatgggtttggagaaaagagcaggcagagaatggggaagattttgaaaggtgcatgtttagttgataaaaaagagatataggaagaggtttaaaaatggaaaaatgaggaagactactagaaaataaaagggaataagagactgaacatgaaacctgaattcagatctcagctagtttcttagaagttatctggtacaatctcttctttatacataagtgagggaacctaagataactgacttgatttgcccaagtcacacagctctattagtattatggccaatgctactgccccacacaactgtgccttatgccacagcatgcagaagacacagaaaaaaagagagaggaagacagaaagcaaaggacgagtgtccctctatcttccctaatcatctaggtcaatagtttatgatactgactgttgagcatgtgacctaacctagactggaacagaatgaagtgggtgtcttagaccctgggtgtctaagatgatttcttcagaaaggccccaacagggctgtgtcaaaggtaatccctttgggattgaggtctttgggaatgtgatttaatcttccaacacagttacagaggtgggaaaagaaagcagagataaaatacttatcagtagggttaactgtgctatttattctgattactggccccaaatccctacagagtggagcaggagtatgaggtaaagttcatgactcccaaattcaaactaacagcttgaaaaacccttaagacactaagactaactgtaactgaagtgctggatttgaatgctgtttggtaacccagaagtttcttcttctttttcttttttttaggcagggtcttgctctgtcacccaggctggagtgcagtggtaccatcttgttggctcactgcaacctccgcctcccacgtgcaagcgattctggtgcctcagcctcccgagtagctgggattacaggtgtgtgccaccacgcccagctaatttttgcatttttagtagagacggggtttcactatgttggccaggctggtcttgaactcctggcctcaagcgatccacccgtctcagcctcccaaagtgctgggattacaagcatgagccaccgcacctggctggtaacctaaaagtttctaatatcactcattcatataacaaatatttattaaatacaaatatttattaaatataatgccaggcactgctctaagtgcctggagatacagcaatgagtaaaacattaaaatctcggccgggtacagtagctcacgcctataatcccagcactttgggaggccgaggtggttggatcacctgaggtcaggagttcgagaccagcctggccaacatggtgaaaccccatcttgactaataatacaaaaattagctgggcatggtggcgcacccctgtaatcccagctactcgggaggctgaggcaggagaactgcttgaatgcaggaggtggaggttgcagtgagccaagatcgagccaccacactccagcctgggtgacagagtgagattctgtctccagaaaacaaaacaaaacaaaaagccattaaaatctctgcccacatggatctcaaaattcagtttataagattatactgcctctttcttaagaacccttagccctaaggagccactactacgctgaagctgttgctttgcttgctgaggattagaactagtgccccctcacccttttttcttttcctattagctttctcaggttgaaccccttttttaagctctagcatataaacatcttgaattagctcacccctttgaggggacccttctgaaatgtttggttaggggctaagagtatctaatcatcatcagtaaatcctcaagtgcctgctcttcaaaggatacaggtactggaaatacaaagagatgtaaaaaaaaaaaaacctgcaaaataagagatgctctcataaagtgatgcaggagctcaagaaagggaaaacgacaactaacttttcattatgaagttaaactatgaaaagaaagagggtacttccacctcaatattttaactaatctcttagagggaccaagaaatgcacaaggagttcatcaatcatcagaaggaatgttgccttctagaccagtaacctctaatataaaaaaaattaacagaaattacactttattagtagtataacaaaaaaattagccaggtgtggtggcgcgcacctgtagtcccagctactcgggcggctgaggcaggagaatcccttgaacctgggaaacagaggttgcagtgatctgagatcaccccactgcactccagactgggcgagagagtgagactccatctcaaaaaaaaaaaaaaaaaaaatagtagagccagctggctcagtggctcacacctatagtcccagcactttgggaggccaagggggctgatcgcttgagctcaggagttcaagaccagcctgggcaacatggcaaaaccccatctcttctaaaaatataaaaaattagctcggtgtggtggcatatgcctgcagtcccagctactcagggggctgaggcgggaggattgcttgagcccaggaggtggaggttgcagtgagccgtgatcgtgccactgcaatccagcctgggcgacagagtaagaccctgttccaaacaaaaacaaaaacggtatagtagtacatgtatacatttatattgaatatataacttgagtataatgaatattcacattttttctgatgatataaacatttggagaccattgcttcagattgtaagcctcaactttacaagacctttagaagaagggcagaatgatggaaagaaggtaggctttggacacagataggccttgacttaaatcctagcttctcagagtttcagttccctcctatgtaaaatggaaatatggtacttatcacttaggtttattatgaggaataaataaaatgtacagagcccctagcacagtgtctggcatgtatacatgtgctcaatgaatgatagtatctagcgctggaagcctgcaagagccatgaaatccatgagaaccaatcagtgtctaaaagcaataaggagaggatcattcgttctcttccttgttggcagagagggtgatattgtgtaaggtgtttatcttcacaagagccaagggaggaaggagccaatatctctgggttcaaagacagaccaggtacacgtgggtccaggcttgtctgaggcatctctatcacatgcattcagcctgacactgctattgctgctgactggaaagggggggggtggttgttttttaaatccttttgcaaaataagcccagaattaacttttctccaacttggcaaagctccttcttccctcacttggctcctcatgagccctaagaaacacacactgctcccaggattccacgtcagtatctaccctgtatacccatcaatagatcagacaatacctgctcaaggcagaaaggactcctctgtgtttcaagtccagagaagggtccctgaaatcaacctcaaatatttccaatgtgccatttgtgctgaaggaggaatctagctgttgggcagatgttcctaggcacaagaaaaggcagcatatgagcaacaatatatgcatggatttcaggtataagaaggttaaggagtgaagaagagaaggaacagaagagggctgggtataccctttctcaaaggtaactccacaaaagcaagaaaacgttggctgggcgcggtggctcacgcctgtaatcccaacattttgggacgccgaggtgggcagatcacaaggtcaggagatcgagaccatcctggctaacatggtgaaaccctgtctctactaaaactacaaaaaaaattagccagatgtggtggtgggtacctgtagtcccagctactcaggaggctgaggcaggagaatggcatgaacccaggaggcggagcttgcagtgagccaagatcgcgccactgcactccagcctgagcgacagagtgagactctgtctcaaaaaaaaaaaaaaaaaaaaaaaaagacgtacctaaccttgagccatagtcctaggcagccctcaggtacccaaaacacctaatatctccttgcttatgctgtgagccaccctatctttctatgatctgagagctttctctgatgttcaataaataattctagatactaagtttcccctcaacttatgtactcccagtggatcctaattcacagtgtcaccatacctgtggccagatacaaagggtattggctggctgggctccatgcctggacagctggccgctcaagttccttcagcttcatggtctatcctgtaggtggcagaaaactgacatggccctcagcccactgaaaatagaaaccagcaaacttaacagccagatccagggagcatctgcggacaagagttcttgtttgtctttctccatcacaagatagggcatttcagggcaacacagagtgacaaatacatgaccatctgcagatctaaagatagttcattcacccaattactgaaatgtaatgctttaaacctcaaatgatactcaaccacaatggctaccacaggtccagtggtgataaccatcaaaccagacaatctctcagtgatgtttgtccatttccttggctttaaatagcacccatatgctgatgatccccaaatttatatcaccatcacaaatctctcctctaagctccaagttcttatatgcaatttcttttcgttttttagaccaagtcttgctctgtcacccaggctggagtgcagtgacacgatctcagctcactgcaacccctgcctcctgggttcaagtgattctcctgcctcagcctcccgagtggctgggataacaggcatgtgccaccatgcctggctaatttttgtatttttagtagagacgtagttttaccgtgttggccaggctggtctcgaactcctgacctcaagtgatcagctgcttatacgcaatttccaatcaaatatttcacttggatatagtagatacttaatgggggagggaactcccattttagtctgtctaaaatggagttctctattctaccatcttttatggtctttttttatttgtttttttcagaaaggagcaaagtcacaatctcttctgttcttcctccagtttttttcatcttggtaaatggttccactatccacccaattgctcaacccagaagcctgaaaatccctcttgatccctccttctccctcattctcttctaatccatcatttagtctccttgatttaacctccaaaatatatctcaatctgtctacttttctctattttcgctgccaacagcctttttgattgtatcatctctcacctggagtactccaacaacctcccaactagctatcccctttctactcaagccattacccaattcgttctttacacagcagcaggagtgaacttctaaaataaaaaatgattttggcattccatgcttaaaatctttcaatgatttctatcacacacagaataaaattcaaacttctttgagccctgcccaaaggctccagcctaccacttcaacttcatcttttaatacttttctcattcattgtgcttcagccacactagcctttaatttcctgacattttccttccttagagcctttacaaatgctgttccctatactttgaatgctcttcccttcactttcgacatgactggctccttatatctttctgggctcagcttacttccccaaataagtgaactacccaatcacaaaaagcctcagtttttttcttcctagtaatttataattacatatttatttatattgacattgtcagtctcttccactaatatgcaagctccatgagagctgacactgtgtcggcttttgttcaccatgttgtaactagtttccaaacgaatgtctggcatatggtaaaagctcgaatgtggacatccattttaactctgtggtttctgatctaattccaatgtatattcaaggtcccatcccaacaggctagcaaacaggtagaaatgatttttaaaaattacactgaacttgaggagaaagcttgggacctactgtgacctgcttgagtaagctatagtcagatcagtctcacctacaaaaacaggagatagtattacttaatctctaaggtactttctagcgtgaagaaagtttaagcctgcccattaagccaagatttccaaagcacctttaaacacttgtggctactatcacgtattctgtgaccagctcaacactctactatacagtcaccagtgccacctgctggtcacagccattttaatgtttctgggaaaagattccctaacaacaaaaataggagctgcgataagcagctgtgcatttgatgtgcatatctcagttaattctctcagtggtcttatcaggtaagtactatgattatccccattttctagagatgacaactggctaggccgggatgtgaacccccatcagcatcaagagcccgtatttctaaccactgtactagtcgcaagtaaaccctagaaagtgttttaatcgctgacagtctaggaactgggaaaatgggctcttaattcacattgttaagaggcatctattcacaaaaaaagggcccccgctggggtcagattggccatgggggcgtgagggggagatgaccaatgaaatgctcgacagacctgccgtgcaggagggcaccagctacccttggcagtccagtccctagggaggacggtcagcacagcctctttcccgctgtcgccgaagcgcggcgcgccagggtcagcaatgacagaccttcccgcccagcccaaacgcagcgacaccggacggcctcggctgggccaggtcaggaccaaggcggatgggaaggcgcaaggcagcagtgaacagggagaccctcatccggctgggggttcccgtgcggcagggacagtagagccggatccaattcaagggtagacgtagtggaggcccccgaggcccggacccgcgggcagggcaggcgcgggccgggggctccgcagcaagcgggctcccctccgcgctctgccgagaaaggagcagtgctccgggtccccagcgcaatctctgctaccagggaccccagaccggcggggcgaaccaacctgtgcggaagaccccggacaagggtcaggcgcggcggccggagccgctcctctggcagggctctcgcgcggagccgggcgctgtggacggcggctgcggaggaccaaagcggcgcggaccccggcagggcaccgtcggaaacacgctccgcgggcgccgagcccgagacactgacagacccacggagaacgtttccaaacaggattatagcttttaaccgggcctccctcacctaccctgtgattgcgcagcgggtcagatctggaccagtaagttctggtctattcagtttgagccaggctctagggccagtctctgaaaagggaaaatactaactcattatctatgtattgaagcgggagaagacccggccctggccccaggagccctcagtggaatccatttagttgaaaacgtaaaaagcaatcgaggctgtaaatggcagtgagtgttgcactgcagcccagcagaaactggtgcccaaaacttggttgaattaagggctataagtgtatggagggtgagactacagggccaggggcttcctgaaatatttgaggaacataggaggggtgttatcctctggagctgcaagaacacaggtgatattccagccgataatgtattttttatgttgaagaaattgtgccacttccaaataaaaatgttctgtagacaggtcgggtgcagtggctcacacctgtaatcccagcactttgggaggccaaggtgggcatatcaccaaaggtcaggagttcgagaccagcctggccaacatggtgaaactccgtcgctaccaaaaatataaaaattagccgggcatggtggtgcaggcctgtagtcccagctactcacgaggctgaggcatgagaatagcttgaacccgggaggtggaggttgcagtgagctgagatcacgccactgcactccagcctgggtgacagagactccatctcaaaaaaaaaaaaaaaattctgtaggcagctttaaatcttagaaacttatgcttaacgcatgaattctctgtattcctgcctgatacacctccaaagatggggggccagttatcatgatggagcccaactcattgtgacacgactccagttcccttccatgtggatctggcaattttgaagttagacagaaggtaattcagtgcattatctgtgcctagcccacgcttcctacctactaagtactcaagtatttcctgaacttcttagctggcacaacagggaatgaagcctgaggaaaagtaaacagggttaaaaactaaacctgagagaaggaggcagaagagttactgatggaatactcctaaagaaatttgaaccagaagcttaagtcacagtttcgggtaggacatgattaagccaaattaaaagtgcactttctcaactcacacctcttaagaattcttgctgggagcagtggctcatgcctgtaatcctagcactttgggaggctgaggcgggcagatcactcgaggtcaggagttcaagaccagcctgaccaatatggtgaaactacatctctaccaaaaaataccgaaaaaattggctgggcgtggtggcatgtgcctgtaatcccagctactcgggaggctgaggcatgagaatcacttgaacctgggaggcagaggttgcagtgagctgagatcatgccactgcactccagcctgggtgacagagtgagaccatgtctcaaaaaaaaaaaaaaaaaattctttttggcctggcatagtggcccacacccataatcccaacactttgggagaccaaggcaggtggattgcttgagcccacaagtttaagaccagcctgggcaacatggtgaaaccctgtctctacaaaaaatacaaaaattagccaggtgtgttggtgcatccctgtggtcccagctgcttgggaggctacagtgagaggaccgcttgggcctgggaggtagaggctgcagtgagctgtgatcacaccactacactgcagcctgggcaacagcgtgagaccctgtctcaatagtaataatgataaagaattattttcactttgtattataactgctggtctcctatgtaatatttgaaggtgattactttgtcttgctcagttttatatctccagggcttatcagtgtttgatacatattagacacacaggtgtttgttaaggaaatgattatcaaatgctatagagaatgaagacagataaaaagccagtggggaccttcaaagaatagcattccacaagtatccactccctgacctcacaaaaggtctctcactgcctgcacaactaagactccacatctaatttgaatgaacttgcttcttttggtcacataaaatgtatgcttttctatgggacaggttttccggcaatatactgtaacttaagaatatgtccccaaaggaatatgggttggttcacttaaaaatagacatgagggctgggtacagtggctcctgcctgtattcccagtgctttaggaagctgaggcaggattgcttgaggccaggagtttgagccagcctgggcaacatagcaagatcccacctcaacaaaaaataagaaacttaggttcgtacatcccagtaatcctagctactagggaggttgagtaaggaggatcccttgagcccaggggtttgaggctacagagagctatgattgtgctactgcacttccacctggggaacagaggaagatcctatctctaaataaaacaaaaaacagatgaatgatagactctcaaaaacatagtttttctctaagactgttataggagtgtggatgagtcatcaaaagtaatcaaagctatgaacatgttcagtagtaactcactgactgtcctccaattcataaatacaggtaatgtcaacttattaagaagctatgattcagaagctgctttggaataaggaatattcttataacggaaataagatcagaggcagtcgcagccttaggcagacaggacaaaaacacttatcagtcctgtaatatacttgaaacacgttagagcacatttttttccaagtaaccactattattaaggagttttttttgtttttttttgttttgagacggtctggctctgtcgcccaggctggagtgcagtgccaccatctcaccgcaaccttgacctcctgggttcaagggagtctcctgcctcagcctctggagtagctgggattacaagcatacaccaccaagcttggctaatattttgtattcttaatagagacggggttttgctgtgttagtcaggctagtcttcaactcctggcctcaagtgattcacccgcctcggcctcccaaagtgctgggttacaggctgagccaccacgccatgccaaggtttttttcgagacagggtcttgctgtgttgcccaggctggagcagtgttgcaaacatggctcactgcacgctcctgggctcaaatgatcctcccagctcagcctgctgcacagctgggaccacaggcgcgcactgctgtgcccagtgaattttctgaaatttttttttgcagagatggggtctcgtcatgttgcccaggctagtctcaaagtcctgagcttcaagcaatccttccacctcagcctcccaaagtgttgggataataggcgtgagctaccagacccagactagaaaggttttttatgtgaaataaatcttgttccaacttggaaagttaggaacatttcttccttgaccctgtaaatgggaaaaggagggacccttaacacctccacacagctaaaacccttaagtacctttacaacccaagtgaaattaacaaattaacattttgtgcctaagtccccatccaccccaccctcttatcctttaaatttcagaaaaagaaaacagggaagacagcagacatcaagcagaaaaaaagggaaaaggatgaggttcctcaaggcagtgactattcctggggaaatgaggcacaaataacacagcactgagttttattagggatttcattaaggttaaatttctaggaatgagggagtcctagttagaggacccaaaagcccacgaagcctcctcagatctcatagtgaaccacccgctctggttctttggagggatcaccgcctcgttccaggtacagattattgtaaggatactgctttggtccctacagaaaaaaacacaggtcagcaagaacatacattcagtcaatacctggctacaccccactctgagttaacaatcacgcatggtaaatgggtacacagtagcctctggtcagacccagctgggctaggaaggcaggaacagcactcctcttcctcactcagcccaaggcagagagaaagcctaaattgtaagagaagtggtgcctacactgtgagagagaaggagaaagggggagggaagggggttagggaaaggaggggaagggaggaagacagggagggaggtaaagaaagagagaagagtgtgttagagtcagaggcaacactttctaaatgagacgatgcatccatccatcccactctctctcggggtcgagacagactcaatctcctttaagtcactcagcctctaatggttccaccactaaagtggcccagcaaatgaggcgtgcagcagcagtggtgggggaaagcacagaggagacaaggctgggacgtgctttaggggctgctggctttaccaacaaacagctgtcagagaacacagctcaaggggaggagaaaagggtgatgtgcttacagaactgaaaaatggaagagccacactgttccttgctctcctgaagtgaagttagtgctcaccctagccctacgtgcattctccagcatggagcccctggggcttggtaggaaggctcgtgtcagtgcacacagacataccagctaccttcaggacattgattgtctctgcagaggtagcactgggcagccaactgcaaacacagcagcctccctgctttcagcttctctccttccagtacatcctggagactactcctggattaatcttcctaagaactcagcattcattatgtcacttttctgttcgaaaacccaaaatggctccctgccacctagaggcagaccaagtcatcactgtatccccaaccgctagcacagtctgcatctggtacatagtacaggctccataaatatttgttcaattaatgctttattacaccatcaagtccaaatcccttagcaatgaaataaaagctgcccaacctaactgaccaacttacctcacaatattttttaacacagtgatttccaaatctaggtgcacatcagaattacctgggagcttgttaaaaataccgcttctggaaccctactgtgatgctactgaattaggagcaccaagaagtggggcctgggaatctgggtttttagcaagtctccaggaaaccaatgcagccggttatttaggaacgattctatacctctattctactccagctaactcaccctccttttccttcattgttttcttttttttttttcgagacagagtcttgctctgttgcccaggctggggggcagtagtgtgatttcagctcactgcaacctctgcctcccaagttcaaaggattcctgtgccccagcctcccaagtagctgggattacaggcacgcaccaccatgcctggctaatttttttgtatactttgtagagacggggtttcactatgttgcccaggctggtcttgaactcctgagctcaagcaatctgcccacctcagcctcccaatgtgccgggattacaggcgcaaaccaccatacctggccgccttcattgttttctcttgccccaaatgttttctccaacttcccaccacccaaagcgtgtgtgtgtgtgtgtgtgtgtgtgtgtgtgtgtgtgtgtgtgtgtgttagcatctaggtagcccttctccttgacagtaactcataccactaagcacatacgtgtgtgtgtgtgtgtgtgtgtgtgtgtgtgtgtgtgtgtgtgtgtgttagcatctaggtagcccttctccttgacagtaactcataccactaagcacatacattcactatacacatatatacacatagattgtacagaattcccatatatctgttcaaatgttgctcatgtaacttatctaaattttcttaactaaacttccttaaagctagagaattcattttctatgtcctttacattctccaaaatgtaagtctatgcctgtagtagactcttaattgcttccaatatactacaggacgtgcccttcacaagtccaacaaaggataagattttcactcaagattccttaactctactgtgaaagatcacttaatgaaatattgttaataaatataatccccaaatggcaactctggtgactagctggtttccacacactcattgctcatctagtcttcaagtgtatctactcacccagactggtccaagaagtaggggtggagaagtgctgtggtacttgtggcaggccaatgggtcaaggccctcctatcttcctatctcctaagactccaggaagccaagcttggtattgactggattcctaccccagagacttcactccctcaggaaatggggctaagcaagcgtgcctaagggagcacttctcggatactcaccacaggctggtagacagggtacacgtcccccacccagcacatgaatatcatgaaagccaggaaaccgaagagctgcatacacatgacatgccaagaaacaggtgtgggggatgtatccacacggttcctgttgtacatgtctaggtgccagtgcatctgaggcagaaagacaaatagctgtcacatactactcttcctgcaaaatgcaggcaagtccccagtgattagagcctgatacaaggctagacagaagcattctactgccctgggacaatatgctgagaaccaggtctgaggcacactgccctacaggattagatgctggcctctgtctaggttctgctgaatagggacagctccatcatggaagtgcacaactttcacagtacagagtttcatgattcccagacgtcccattcagtgtgccacatgcaatctcagatctcacatcactggaccttgcttccttgagcaggaaagcttagtgttacttggtcaaagaagtgccatctgagctaaagaatcgccaagaagacaaagagagaaggaaggtcaaatgagatatggttctcttaccggttcaccccagttcaacctcaggcccggctggtcccagctataccatggatctctctcatgctgtgagcggtcagggagcttcgggtagtcgccatacctgaaagacagcaagaacttctggaaagggctgtgagcagcctcagacaattcagagtctcctcatcttatagatgagaaacaaagtgacagagataactgcctcacctaaggacaaaggaactaaacctcaaggcaagagctcaagttctagtcactaagcacagaattaaccatagaagtccacactgtatttaaaagttcatggcaaactctgaaatattttaatgtacataagccttccctgggccaggtgtggtggctcatgcctataatcccagcactttgagaggctgaggtgggcagatcacctaaggtcaggaattcaagaccagactggtcaacatggtgaaaccccacctttactaaaaatacaaaaattagctgggtgtggtggcaggtgcctgtaatatcagctactcaggaggctgaggcaggagaatcacttgaacccaagaagtggaggttgcagtgtgcccagatcgcaccattgcactccagcctaggcaacaagagtgaaactgtctgaaaaaaacaaaacaaaacaaaaaaacccagcttccccaaacttctttcaataaaaagaaaaaaagtcacacaatcgtgtgatattagagatgaaagggaatttagcaatcaattacagtcatgtgccacataccatttcagtcaatgacggacaacatacacgaagggggtcccataagtttataataaagctgccctatacatatgtaccattttttatctttttctcttttttgagacggaatcttgctcttgttgcccagactggagggcaatggcacaatctcagcttactgcaacctccacctcccgggttcaagcaattctcccgcctcagcctcccaagtagctgggattacaggcacctgccatcacgcccagctaatttttgtatttttagcagagacagggtttcgccacgttagccaggctggtcttgatctcctgacctcgtgatctgcctgccttggcctcccaaagtgctgggattacaggcgtgagccactgtgcctggcccattttttatcttttatagcatacttttatgtaccttttctatgtttagatacacaaataccattgtgttacaatttcccacagtattaagtatagcaatatgctgtacaggtttgtggcctcagagcaacaggccataccataaagccgaggtgtgtagcaggccataccatctaggtttctgtaagtacactcctaatgttcatacaatgaggagataacctaacaacccatttctcagaatgtatccctgttgttaagtgacatatgactgtactctgattccctcattagatagaaaatgaaaaattaaagtttagagtctgaatccaaagtcacccagctaattggaataaaaacaaaaagggtacagattagaaaagcactcttctcgtaataactgtgttcttgaccacccagttggcattcatctctgcgtctcaaacacctcatgggacctcttgctaagctgggttttccccaacaaatccaggttcatctgacactggcttcgaacaaggctgctcttgtccacaacataagaaaaaacaggaaatgatgacaactagacatatgctacagaaaatgagtgtataacaagaagaatagaagttgctgaaaccaagattgaaagagtgacattaggacaggaaataaaggcgatgataatcacttcagataattaaccattgggatgttatgtgggtatggatacggaagagtgtggaagggataggataacatcaactggagtacgtaagggggctggctgtttaatctgcttaatagttgctacgatttccacagcactaacagaaaaacattttttttaaagagacatacacacaaatatagagtactccgtttacaaataagattctcatgacaggagtccagctccagcctggtcacatgcctggatgacagcacctgagcgcagcagatgctcaatctaaatgaaactcgacgctctggatagagccaaggaaggctcctgctattcgggggtcctcgagggagccattaaaacctcggcttcctcatttgaggaaacagcctgagccaaggagaaaattgaagtcctctcagctgcagctgctcacccacccccctcccacctccctccacagagaaaagcacccactccattgactctgaggggtcacgagaaggttcgggaaaaagggtcacagtcaagccacccaacccagccggccttctcccatcactacttgggtgcgagcataccctctctgtctcaccccatgccatcatccgggtaaggttcgtagtcttccacacgcatattatacttcttggcggcggcggcccgttcttctggggtcctaggatagggccccgggaacatgtccttggtcatgtgggaggctagaacgcagaagagaacaggtcagaagcgagcccgctctccagccgctccgaaggcttcaagtcgcaggggctgcagaggtccgagcccgggacttcgcaggatcagtgcgatcctccaccccattttctggatatatcaacgccacctccactccctacccggaggctgccgccgcggcatctacgatcccccctcccgatacaccaaatttcaggtacccccttcccacactgaggtctcgcccgttctcgcggacctgtccgtgcgcccagcggcatcacgttccgggatgccctttgcagccactggactcccaagaccccggccc

SEQ ID NO: 473 - DNA, 33532 bp, Homo sapiens
aactgactcaggctaacactagagttgcctctagtaggtgtaattatatcatattttatagatgaggaaactgatgaacccaaggttacataactggtaaattacagagccaatatttaccaatcttgattccaaagcccagactatctgcatgatgtcatattgactccatttacttatcaagagttgaagttgactggaatatacagtagccaggaacagtactgctttttgtgaatgtgtaattcaagagtaagtgattagaaggttcttcaaaagctgatgcagttgatctctgagcagagttgaatagtgaatattttcagtggatattgcccactgattcaagggagtcacccgtgtggttaggtctaatagtgagtgaggtactatcaaggcaaaaattgaaagagttccagttacctattgctgtgtaacaaacttaattaaaattaagtaattttaattacttaaaatcaaccatttcctatatcatggttttgtgaatcagaaaatccaggaagggcttgtctgggcaattctcctccctgtgacaacgactcaggtcacctggtggtattcagcaggtggttagacaagtctggaaggagtgtccaagatgatcgatcttacatacctgacactttggtggggagactagaaggatggactcagcaggtctcctctttctctccatgaagtctaaggactctccatgtgttctcttcatcaaggtagtcagatttactacgaggacagctaaggcctctgaaaggctgggcagaagaatctagtcaacttaaaggccaggcctagaattatcatacagccaccactgtactcttggtcgaagaacttaatggtaagatgacagcaagaatgaagggggaaaaaagaactcaatggtcagcccaaatttaaggagagaagaaataccctaccactttatggaaggcatgtccaggacttggggctatttttaatgtgttaatgttttttttgttttgttttgttttttgtcttgactctttggtgtttattcatcagttgtttgtgctgtagaaaccatttattatgtctaccatgggtcactaaaggagctagaaggagaatgagacaaatatctggagcatacttcatttgctgccctctccctccaagtttcatttatcttatagcaaaattttcattttgtactgtgttccaagttgtgaacatttgcctggttttgctctgaagccacggtaactgcatgcggagctagaaatactctagagggagtaaaaagcttacattttttttgtttgttttttgttttaggacagagtttcactctgtcacccaggctggagtgcagtggtgcaatcacagctcactgcagcctcaacctcctggactcaagcaatcctcctacctcatcctcccaagtagctgggactccagacgtgtgccactacacctggctaatttttgtgtatttttagagacgggatctcaccatgttgcctgggctggtcttgaactcctggactcaagagatccaccttcctcggcctcctgaagtgctgggattacaggcatgagccaacgtgcctggcctggaaagcttactattaaataatttgatttcttggagatatcagttgtattttaagtttacaaataggtgaatactcttgtggtatggaaacattgcatggctgctgaatctctttcaacaggagtttctattgggtggctacatggatcatattcttgagatagtgaaaagttttacctacttatcttaatcccattctacctctacacctccagcatgattttgtgctcgaagatgaatcaattcctttcattcttgttacctttcatacaggaaaattcatcgcccaattttatatgttgttaatcttttaaaattggcagttgttaccagcctctctcatttaaaataacagatcattgaagttttttgatttttggttagatgtgtcagatttaggatgccttatttaaactcgtgctgtcttactagactgttcctgctctgagaagaaatatggacagagaatgaatttcattgtccatattgatgaaccccaaatcaatacacttcttaagaaaggtttgagattatccagtccatgtgcaatgaatccttggagcattagctgtgtggccttcctactgataatctgcagttatcacagtaaagagatctctgttcctaggtcaggccttagcaattacaaatacaggaaataaaggggtactcaatgctgaagacttaattttgggtacctacaaagtcctgggaagggaaaaagaagaccttggcatttgtatttgcataaccagagatggaatgtttgaggcttttaggcataaagattaattagattttatcatataaagattagggcaaattatttttttttccagttcattcttaacatgttaagggacaaattttaatgaataaaaatttaaaggccttaaaactttcttttggattcacatttccactctggtataatccactctggtgtagtctgccctttatgacagagaaagcctttgaaaatattgtcccagggaatgaaaaatcttaatgatgatctatggaaatgtctctcattctctattacagccctttgggccctcctatagattctctgtgaatttaagtttgaaatcatttggtgtttgcatgaaaaataattcttactattcatttaaataattcttaaatgtggtcttaaattgcaagagagaacaaagccagaaaaaggggaaccttgtagattgaccaaatatttattctttattttcagcatcacaaatctaaaccatttcaagctaatacaacaacctgagtgagtagaaattccttaaggtttagatttctgcttttagtcacatcttgaagcagatgtttatgacatatttgaagatgatccactgagtttcctataaagtaatagaatcctaactatagtggttctttaagaaccactgaaaaaacagaattgcagtgcagggaacaaagcttaaaatgtgtttcctctggaagccaagatgctaaaaaaggggtcactaatagtgtgactgaagtccgtctctagaatggctatctgttagatagcagaaatatttagaatgtatatggcatttctaatatttttacaaaaataattttaaatcatgtaactcgaattttttttaaaaagtctgttttctttttggaaaactggcacaataaaaataacactaatataattccattgtatatgcatgtgcattgaacccagagtgggtatactaaagatagttcatgcaaataacttatgggaagtttggctattttttcatgtatgtttataaatatatttagtcatctactgtgaccttggtagcacagaagcattttgttagctgtatcattaattctaaaaatcaaattcttggcatagtaggctatgagagctttttgttacttggtattttggctaagaaaattatttcttgcactttctatttgtaaagatgttataacacaatgcacccacttaatgcagcttttctttagagaaaaaagatgtaggtgtaaaagtgaaatgtatgttttcaaacctggcaaaaggagggacctcaaaaaaataaatttggcttgccatctacctgagtagggttggggattaatataaaacttaggttgaaagtggctgttgggataggtatactgttgctgtgaattgcaatattgctgtgagttgccagctatgtatgtgtaagtttatgtgtgtatgtgagaaaaaggtatttcgtgaaggcataaaagtcagtgtagaatatcctacctcccactagagactgagcatattcaagattgctctgtagtcccttgggcaggaagctggattcctcagccactgtctaccccattcttctctatactcacttcagctcctctacctctgagcacttggctgaagaaagagtatagctttctgtagcaagcaaaggaaagccagacccaaaatagagaggctgcagtatctgaaattcttatcatgttcagatatcaatatttaattttgttgcccaaatcaaacaatgtcagaacacttgagtttagtgcttttttttctctctctgtctcctacagacttctcccggtttactgcttttatccactggcttctgtttggcaggagtagccagtggaggtcaagtctgtttttaaagactaaaacacctaattccttttaatgatgtgtaacatttgtttgaatccccaacttctttttttttggggggcaggggtagagatggagtctccctatgttgcccagtctcgtcttaaacatctaggtttggttggatgcagtggctcacacctgtaatcccagcactttgggaagctgaggtaggcggatcacctgatgtcaggagttcgagaccagcctggccaacattgtgaaaccccgtctctactaaaaatacaaaaaattagctgggtgtggtggcggcatctgtaatcccagctactcgggaggctgaggcaggagaatcgcttgaactcgggaggtggaaattgcagtgagccgagatcacacggttgcactccagcctgagcaacaagagcgagactccatctcaaaaaaaaaaaaaaaaagtctgggctcaagcgatcctaccacctcagcctccccaaagtgataggattacaggtgccagtcaccacacctggcccatgatggattttcagatgacctcttttacttctaatctctccaaagagagatattcttgtttttaaggtcaatattgtcataatagtcatgatgtcctcacctgaatgttgtaggtgtcagaaagttgtttcaatagtaatatgccaccaggcagaccacctaatctttaaatccagttgtagcactcaatttattttctgtttggggcactagtgcactgagccaagtcaacttgtccacttttctaatatttcttacagctaaggaggaactgttggtcctttgatatcctagaatgctttctacttgtggaaatgctttttaccctaatacactgattatattgtctaaatgtctaaacagggattctctggttagaagtgaaatgagagagtgacccattttcagatttttagagattggctcccgtattttaggaactagctgataagtatttagtttcctggtgactttggatacggcaagtggagatgcagagaatgtgaaattccaaataataagacaagcattactcacaaataacaactgatacagtaatttctgcccaaatgcagtaagaatcttgtagggagatgaagtggtaaaattaaattatatgaatctttttaccacgactatttttttttttctacctgtagcatagttctctgcctataagccatgctaatatcctagacccaggaattaattcctgcttaggaaaatttttccttctggcttatcttttgtttgtgcccagagttttgtcctaggcctgtcccctgatcttttgctataacacatacttaaggtgcagccttcttacctaaatcagtactttactgttgctgttgctgcctattacagccagttatttatttaaaaagtagtgaaaaaatgcctaggtagtttgattgcagcatgttaaatccataaatctggacagaagccatggagtcttaccttttctctctctagcttggatgaacaccggccttatgctttctattacaggactagttgacccagttcttcatattggttgcacattagaattgcataggaccccctctagacatttacattttattggtctgttgtgcaacctgggctttaggtgattctaatgtgcagccaaggttgagaatcactccctatgtaatccctagtggtcatggcaggataacctcaatccagtcctctttgacctgaaaatatctttattgatattccatgcatggctctcaattcaaagtgtacagtgggtcaaggcttaggtagtaaaatggatcatccatttgtcctcagaataattctggagggagatattgtcatccatccagtttcctctctataccaaatacaaagtacacataaataagcaaaacaaattttcaaagttccttctctagaatcctctttcttttgcatatgtagtttcagtggagatttctcaactagctgaaatggagcacttgaatatattaaaagagcccaaactgcttacagcaatttctatttgtaaaataaacaggtggcattgttaatggagaaaaggaaggatcctgcctgtggtgatggtaatatgtttgattatttatctcttagcctgtcttctaagtgggatttcagtgtcagttaactttcacttttcttggattgtttttttgtgaatgaaatgaactagttaaggcttaagtatttctgaataatatatgaaatgtgaaatgagtcattttaggatctttcttctgggatgtcaaagacctaaccaagtaactcccaaatgaggttccagattcatttttctcatcccaggtagtaaacgtgttttaatgggtttgtttcttgcccatggcaacctcaacacagaggggagaactgttttattaccctaaaatagtgagaaccactgttcaaactaactagctaccaagtgacttctaactcatgaagaaaatttgtatttaagagcaagttcaaatgtagcaggctctcttctgagagtattctggataccacggaaagtttcatttatatattgcttacaagtacgtggtaatttgaacttcagtaggtgatatgtgcaaggagaaaaagtaggtcaaggagaaagttggttagtgcagaggactgacttagcatcagtctgtgaaatttcattaaagtagcactaaggcctggctgtttgcttagcatgtaaatgctgcagtgtccaagaaaatgcctcctatgccttagaaaatttgctgaaggcttcctgttactggtggagtagaaaagcaatagcctttgagactccaaagagagtagcccccttagggttttcatactgaagaaccttgtggagtactgtgaaacattgttgaactttatgcaaattatactgcactggattttaagattttatggggagagagtagagcagagtggggaagtaatgataaaagataaatacgtaaacttgtactatattttaagcaaggaatgaaacaaattccctaacaggaattccctgtcagcactgtgaagtttggtcaagttctgcctaatgggttggcttgctgattcctcttaaacctctaggaaatcctttctaagacagcaaaacaaacgttagtttgagtactactatttcaccaccctgctccatccccctactctcaacgaaagaaaagcattcccaaactataggcaaaagaaatgtgttctcagtccattaatttttcatctgctatgatctctgttcacagttttagcacattgcattattttgtaatctgatagcagaacatcaggaactaatggcttccttccctttaagaaatcttaaagttagaacttttttttttttttttttttttgagacagggtcttgatctgtcacccaggctggagtacagtggtgcaattatagctcactgcagcctccacctcctggactctatcctcctgcctcagcctcccaagtagctggaactacaggcatgtgccaccacgcccagctaaattttctattttcttttagagacagagtctcactatgttgcccaggctggtctcaaactcctgggctcaagcgatcctcccacctaggactcctaaagttacaggtgtgagccactgtgcttggcctagaactctgtttttggcatttctttctaaatgagtacattggaagaacatttaggtttccaggctcctcataatttctgaatgggacccgctctgctctgcctctgaaaggaggagaaaaggctgagggttcaaagacagaaaagtcaatgtagcagaaatttgatttccttcagatggacatagtctgaaagaaatctatccagctgttctctatggtgcttatatgatgggtgacagctgtccccatctacctgtccctggcactgtgccttcacactggtcactgtgaaaagcagatcacactggactcagaggccagaatccaggacaagatcccccttctcatcttgagcccatcacatctttgtatagctgttaatgtagcatttacttctctatgggaaactcttgggtttttaacccaagaagaaattgtaaagcatttaaactagtcagaaaataagattctgatggtagcgatcaaataaaggaaaatttcacttcctctcagttgatattgattgatagcaaggatcaactatgcccacctcttcctaagtttctaaaggctaccataatatttgtaaacaacaaatttatctaatattttttacaacttgctaatcaaggaggattcatattaaaacagacaatcagtttctaaaatgttatccctgaaagggaatggaatagagtatttttagctgtaagaacctaccagtctgttttttccctttgaaaaaaactaatgtttgagatttgtgtcttttcatctgaagcagttactccattaatagtaaagatgcctcgggaaagtcagtgaaccagaatagtgctcttgcaccactgagggtgctagactggctttgtgcatcttatttcctaagaatatcagtttttattatgaccttaattataaatacctatatataggagtaggattttctctcacccaaccctactttaatcattatcacttaagtgtaaacctccacctccccctctttccctttaccgaaaaaaaatgcactttaattcctaaggagagtggctgttcctggccctgaaaccagattacttcaggaggagagttaaggagggagagctcttaccagaccctgtgaaatgaaccaaatttcttaatgtaaacacacaagtaataacatccacttttaagtggcccccactccatgccaaagggaaaaagaaccgccaaattgaaaaagggttctaaatacctgtcctgattttggaagtttcactggggaaaaactacctaagattattttcacagctaccaatttgtcagaaactttggtggtgttttgtgggaggctgagattttttaaattaaaaatcaagtgaaaacacaaagactctaagacacgatcctgatttgtgtcatttctaagtatcagatttgttctcccttcatttgacaggtgttctcagtctctcctcctgtaagattctgtccttcccctgatgacaagccaatagttcttggtggggttgcatgtctcctagagccccaggacccctgtcgtgtcggggaaggggggagggcaggagggtgggcagagactcgggttgggggagggagttcaaagaaagagtgaaaatatgggtttatataaacatatttaaagcagtttagcaaaagctttctcgttgaacagctttaagaacaatgtgaatgaaatcttagcaacttggttagtaatctgaaaagtctattaatgtatacttgaaattctgtttgtataaaaatgcattttcccctttattttaacactgtgtaaaagaacattatgcatgtgagtggtttgagaattaaatggtttaatactcagatttgaatctgtcttttctgtatatagaaactaatctgtttaaatttttgatatgttttagtgtgatggaaatactgagaattcactctcccttccctttctggctgtctaccatcttttatcgctctctccctcattttcttgatccagatgtggttactgggtaaagaacaacttgaaggcatcattttaccatgtgccccaatagcatgtttcccctttccttgtcttcatttcaaatgcagagtccatttataatgtgagatggaagtagtttgtatttatttttacttctgttcacaaaccaaaaataggaagaggtgcaaagaataagaacattttacttaacacaagggttggctactctgcccatgaagataatagtgttcagaggaacttctcttataaaaaccaggaaaggcctgttggccttgaaagtcaccctgttggggtttagcgaacggccagcaatcacaacagcggtacttgcagctgcttcactgccttcttcatttacctgcaggtcacatgggaaataaaactaaattagccactctgccgttcatttttggcaggtaaatcatccacagacacagcaattcctcaaatgcttttgttttccagtaaaaagtacatttgggtcaggttggattccctccagaatcctacttctactcattctttcatgcagagaatgtaaggtacttgtgtttgtccaagccttgtgctaggtaataagtgtaagagttccattcaggtaacccagaaatctgaatgtacacaggttatcacatttctggctggtaccattgtaaatggttttacagcggattttttttgtaccagccgctgaaagatttttggctcaagatctgaactccatagttgaaagaaacagtttcactcttggagcatcaagatccaagatacagctactccaaagagccactcaggacctagggcctatgaaaagaggtgggttctctggctggacgagatgccattttcttggagtaatagactgaaacaatggtatttgaacatggctgataagcagatctagagggaaacaccttcagaaaattttgcctcaggacccagaatatcactaaaactctgtttctgctcttaatgaaagcacatgattaaccggctccctgggttttgtggagctggttgatgatgtcttctccttccttctcactcttccttccccttcctttgttcctcccttccttacccgctatctccccatattacctatttcatgctcattccagcactaaattattagcttattagcagactagagtgtttgcatgaccaggatccttttattcaaatcagattctggtttttaatggcttctcaggtctacaattagttggggtcctgtttattaaggattcccaaggttttcaaagaaaacggctttgttgtaagaaccatggaaaaatcttacatattgtgtactgggctcaggtggataaaatgaatccagacctctgcttcttcctaatagtaactcagacccctcaaggaggtctgagttgaccacttctaactggagtccttaccagaggatattcaatgagagttaaaaccctgaggactcaatttcccttgcagtcttcctaagtgttctttcttccaaaaatccatgtgaaagagggtgtgagcagtgtcatcttaacttccaaaaccattaatacagcactcttgtaaaatcccttgttctgacctcaatacctctactcttgctattgtcttaaaggtcattgacattcattgtcctatagattatatccccacactgatgatttttgcacttagcctttctgtccactccaactcctgctatcatttgaggcaattaaaatatctcagtaggccgggcacggtggctcatgcctgtaatcccagcactttgggaggccgagtcaggtggatcacttaaggtcaggagtttgagaccagcctggccaacatggtgaaaccccgtctctactaaaaatacaaaaatttagtcgggcgtggtggcgggcacctgtagtcccagctacttgggaggctgaggcgagaggatcgcttgaacccaggaggcggaggttgcagtgaactgagatcataccactgcattccagcctaggcgagagagcaagactccatttcaatgaaaaaaaaaaatctcattaggagacccgttcaacaccctagtctcccatttctttcatcaaacctaatgagcattgccttcattccacttaagcaaacctgtccatggctacaccttggacttgccatctcagaactactctacctttgaaattatattaatagcatccttttctcagattataaccttgtgttctttcaagctatcacatttcctcgctcccgttaaaattccactttcctctgagtttgatccctggatctatatttacttagcaccatcctctgaaacctttctctttgactacaaccttcattcttttcgatttctttgattctaggaacatctctaccattgtccaatctcctatccctcacagcctggctcccgcaaaaaatagtctataccagtggttcccaaatctcattgtgcataagaatcccctgaggagtttagtacatacagagattctcagggcccatcccagaatctccaaagataaagctccccagataactactgctgttggtccatagtttagtgtttacttgagaaccagaagttccacaggctgtacacggctattactctaacacagggttccatgcacatctcatttgggggaacacgttaagtgatattcaaccgtcttctttactgtgggacttgtcagacctcagcatgtcagtgtgtactgttcatctcccatgagaggatatgcatttatttgaccaccttttcgtttcctccagtgtagtctagtgctctagttggagcacactttaagacactgatgcacactcaccagcttccctttcttaccttccatttgctcttcatccattacaattaggcatgtggccacactattctgtcctcagggaaaggtaaactatgggcagtctccaaacttttttttttttttttaagatttttttggtagagacagggtctcactatgttgctcaggctggttgcaaactcctgggctcaagtgattcttccatctcagcctcccaaggtgctggggttacaggtgtgaaccaccatgcccagcccaggagtcttcttactagatgctatccattttcttaaaacttctccctaggttggccgggtgcagtggctcatgcctgtaatcccagcactttgggggtgccaaggaggtggatcacctgagatcgggagttcaagacctgcctgaccaacatggagaaaccctgtttctactaaaaatacaaaaattagccgggcgtgatggcacatgcctgtcatcccagctacccaggaggctgaggcaggagaatcgcttgaacgcgggaggcagaagttgtagtgagctgtcgcaccattgcactctagcctgggcaacgagcgaacgaagctctgtctcaaaaaaaaaaaaaaattctccctgggtttctgcgaccccatactcttctggttctcctcatgctgtaaatttcttcttgatggcctttgctggcttcttttcctatatcaccctccctaaatgtttgtgttcccgcttgacctgctacagaagaggtagtgggagggaaggcagaacaatcacaccatgaaggttttggagagggctgtattatagcaggcctgtggaggccttttgcatgccttaacactggaaacaggccttttccacgtgttcctgctgttcatgcatctcctttctgtaccctaagagagtggggaaggtgtactcacctcaagaaatgccttatggaatgcatctgagacatagaggtcatctcggccttctgcaacaatacctggaaggaagaccggagaagtctttgtgagatgggagaaagttggcttcaacccacagatgggaattcagtttggattaagagatcctttggggctttttgaaacataagaagaaatcctaaatcttcacctaatcatactctcacaatgaatatgtgttaaaaataataaagtactttgggggctgggtgcagtggctcacacctgtaatcccagcacttcgggaggccaaggtgtacagatcacctgaggtcaggagttggagacactctaactaatatggtgaaaccttgtctctatcgtgaaaatacaaaaattagccaggtgtggtggcgcatgcctgtaatcccagctacttggaagactgaggcaggagaatcgcttgaactcgggaggtggaggttgcagtgagccaagatcacgccactgcactccagcctgggcaacaagagcaaaactgcatctcaaaaataataataataataataataataataataataataataataaaagtactttgggcttgttcagcatggctcctgataattcattctcaggcttcagctttttgtgggagagagaaacggcaagactctgttcttacagaaaaaactcactccatccagaaggaacatctttctttccagtctggcaacatttttagttttcaaaactagcttaaagacagcccaatagcacagtggctcacgcctgtaatcccagcactttgggaggccaaggcaggtagatcgcctgaggtcaggagttcaagaccagcctggccaacatagtgaaaccccgtttctactaaaaatgcaaaaattagccgggcgtggtggcaggcgcctgtaatcctagctccttgggaggctgaggcaggagaatcacttgaatctggggggtggaggttgcagtgagccaagattgcaccactgcactccagcctgggggacaagagcaagacttcgtctcaaaaaaaaaaaaaaaaaaaaaaggtcaataaagataaatctaattacttaacatcgtaaacttattttattatttatttatttatttagtgataggacctcactctgttgctcaggctggagtgcagtggtgtgatcacagtacaccacagcgttgacctcccggactcaggcaatcctcccagctctgcctcccaagaagctaggactacaggtgtgcgtcaccatgcctggctaattttttttattttttgtagagaccatctcactatgttgtccaggctggtctcgaactcatgggcttagacgatcctcccacctcagcctcccaaagtgctggtattacaggcgtgagccaccctggccagccaacttctttaaaagatattttaatgtgccaggtgcggtggctgacgcctgtaatcccagcactttgggaagccaaggcaggcggatcacaaggtcaagagttcaagaccatcctggccaacatggtgaaacccatctctactaagaatacagaaattaccaggtatggtgacgtgtgcctgtaatcccagctactcaggaggctgaggcatgagaatcgcttgaacccgggaggcagaggttgcagtgagccgagatcgcaccgctgcactccagcctgggcaacagagtaagactctgtctcaagtaataataataataataataaatgtcagtgaggcctgtgtaatgggaaccacatttccccagctcttaatatctgtctctttgctctgaattccaatgccctttcaaattcctctccacctggtcccatctcctctacctgatacagactcacagggcaccagtgctagctgggcccatggagatccaagaacaaacttcccttttacagaagaggaaactgaggtctcaaaaggaaaagagatttccacaaattagcagtagaaactaggatcagtatccaggagtcctgacttgttgctcctttctattctttctccaactcttccacttttggtcagactaccttgcgggtggagaagggaggaaactccttcctagacaaacctgggagtttggacttttcagggctgaacagatcgacaaggcccatgtcttgcagctgctccttcaaactgaagccgtcctcaatgcggaagcggggcatgtggaccaccagcatcatctcctccaattcatccagccactcttgcagcacctctggggtgagttccttctctaccttggccaggctcttctcaggcttgggcaagatgaggaccatggtgatgtcatcacctttgaagggcaactcaagcacctgggtgccttcagccacgcgccgataacggaacttgccttcctggtacatcatagatgctgaacacgactctccatcagccttgtagaacagttccttccttgtgttctcagggctgaactttgacttccacaggccctggaagagaatcacaaagtaagaacacaaacattcataggaggatagttattgacacaagacatatccatattatagtgttacattaatatataattattcggaaaaaagactggcgggatatgcacaaaaaggttaacaatggctgtgtcagaatgatggaattatgagtaggtttattcataactgtcaaaccttggaagcagccaaaatgtccttcagtagatgaatagacagactgtggtacatccagaccaaatgtaatgctattccatgctaagaagaaatgagtgacaaagccacgaaaacacaaaggaacagtaaatgcattttactaggtgaaagaagccaatctgccgggcgcggtggctcatgcctgtaatcccagcactttgggaggccgaggtgggcagatcacgaggtcaggagatcaagactatcctggctaacacggtgaaaccccgtctttactaaaaaaaaaccaaaaaattagccaggcatggtggtgggtgcctgtattcccagctacttgggaggctgaggcaggagaatgccgtgaacccaggaggcgaagcttgcagtgagccgagatcacgccactgcactccagcctgggcgacagagcgagactctgtcaaaaataaataaataaataaataatagattgacctgccctgctgacctgtacctgtgtagctttcggcagtccatttgccctctcagggcttcggtctcgccatttaaaaaaaaagggggtaagctgaagagcaagaggaagtccctggggtctctccagggccattctgagtaccttgaagtaaatggtgttaaccagcaccagaacagtgagctcattgatggcttccgagggaatgacatcggtgattcggccttcggtcttattggacacccatttgttgatggccgctctggattgctctgcattttcctgaggagaacagaaaataaacctactcacctgtgctattcaattggcttctccattttcccaggcagcattttatttttctcaccatccctctgtcctttcccaccatttgattaagaagccattgctctaacccaaattggggaagcctcacatatctaatatagttccatgaatctttcctgtagttaataaatattatcagaagaaaaagaacaaaaagaaataggaagaaataaatgaaaagaaggaaggcgaaaatagtctgggaaaaagaagataaaatattattttctctgactttggaaaaccttaactcacaaaagtagaatttccaaggcatgtgccaggggaagcaatgaatgattgcaggttatatggggttggcaggttatatggggttggcaggttatatggaggagagaaatgcccatgcagtcaaatacatttgaggaatgccgattgaataaagccaacagatttctttgttgcagagtttctcagaaccttcataggcccatgtgcttcatgaatctccaagaggagaatgtaacatgcatcatgtaccaactttatttgaccatgataacagttcaaattaagtaagatatcttgtagaactggcatcttcaaaacaccctttggtatatatttgaagttggtggatggaatgaagaattgattattaattcatgttttctgggcagtcactacaatccaagcatggatacctttgatttctcaggtttcaagtaagaataactattgcaggggttctaacttttagtcagccctccagcagtcttcagcagcaaagcagtgtgaatttggatgctgtttctccacctcctcaatctctgagtggagaggaagaactcggaggtcaggggtaacatctgcaactcaccttgaagtccaggggctggagcttggctccatataccaactcactgatgtcctggtaggtctcattgaaggtaagggatttgtctccaaaaaggcgattggctgatactaacttggaggatttgttggcttttcgatagagtcggcagttcagtttggcaaagaagaagtggatctgatcagatgttttctcagatatggtgtcaaacttaaatacctatagaagtcaaaaaaaaatggtggtgggtttggtgggctgcctagttaacatgggtggtgagcacatgctggtcagtctctgactaatagccacctcagttgttaactccttcaagcacagtacctgggacagcataaatgctcaactcttgtgttctgatgaataaaaggataaaagaagaatgaagggtaggaaggataaagggaaaaagagagactaggttgccacctaaagtctctaaacgcctctagatcaacacacagacgttttcttgctggaatgggaaaagtcctcttggtgattctggacagagaagagaatcaggacggtgtccttctcgtaacaaacacttttgtggcatctactggggccagctgctcatggaggctctgggatactggtggtaggggtgaaaaaggaagagtgaatctatcagcaagggattaaacaggctcagaatctaagagctcagggctgaaaaggacttagaagtcatccatgctttgaagttggaatcccccaatgcccaccttcaccatccccaaggcaaaatgggtgaggctgttcccctcctgccctttccatgctctctcctcaggctacaaaaggccttttggttttatctgttctctgcctttggttttcctgattttgctccaataggcactttttttagggggggattatgcttttgatcaaaagcttggtgctgaatctctcttttctccagagagattcagtctcaccctgctttcccaacacatggcgtttgtgtagaggggaggaccaaaggaacatgtgtggtttggaagcagtgttctgttctgttcttcttgtaggaagggttacatttaagatcttacctggggacagagacatgagtgatatggaagtactttgagaccagtaccaatgtatacaaaaatgactgaagggcccagagaaggcagtattatgtgtcttcagagtttttaaatctacaatttctttcaaagagtgaagacttgggttaactcaccccagagccctgagcaaaggtgatgaagttccatggaaattgaccactagaatagaaggaaccctcctaagacccacagactttagtgtccaagtttcaaataagcaccgtataccatcttgaagggactcatgcctccctattgatgaactctgcttccaaagtgtgatccaacttgaagaaagactgtcatgcagccaagccaaggacagattaaagatctagtgtttccatccatgacttgtcatagccccagaggccaacagtgatcaatcaatctatgacatttcatcttatcatgccctacttccctcccacaaaaggcagtggggggaagggggtgggaactaagtcactgagctgaaatgatccatacttcccagagccagaaaacactctcacgtccttgaggcttctcttggctttcctgggcccctggtctcaatataccatcctaggccccgtgcagtggctcatgcttgtaatcccagcactttgggaagccaagtcaggccgatcccttgaagtcaagagtttgaggccaggcgcggtggcttacgcctgtaatcacagcactttgggaggccaaggcaggtggatcacgaggtcaggagttcaagactagcctggccaacatggtgaaaccccatctctactaagaagaaaaaaaattagccaggcatggtgccgggggcctgtaatcccagctactcgggaggctgaggctgagaattgcttgaacccgggaggtagaggttgcagtgagctgagatcgtgccactgcgctccagcctggatgacagagcgagactccgtctcaaaaaaaaaaaaaaaaaagtttgagaccagtctggccacgtggtgaaaccccatctctactaaaaatatagaaattagctgggcgtgatggcgtgtgcctgtaatcccatctactcaggaggctgaggtgggagaattgcttgaacctgggaggcagagtttggagtgagccgagactgcaccactgcactccagcctgggcaatagagcgagattccatctcaaaaaaaaaaaaatactatcctagaatttttttccacgagagcctatatgcctgatgtcaccatatggtaaagctactcttcttccaccagaggagggactggcactacacattgcctggcacagaggaagtgctgaatgaataaataaataaatgatcaaattaatgagtaaacatatagatgaaagaattactgaaaagaagttgagagaagatacaagccttcccccattttaaggtgctcaaaagaggaaaccaggatttaaaaagtagatagccaagattccttggctaattttttaaaaaatgattttcaaagggaattataacacagtgatgttcaaagggaatcgtaatgcataatgagcgcccctagtggcctgcagtgttggttgaggaatcattggacttgggcctatggaagccccaaaggtgctcctaacaaggtggctgggcagaagacctttggtcgtacctccatcagttgctggagggtgtcattacaggcacccagcttggtcatagcaaaagccgtggagatactcaggggtgacaggaaaatgttatcattgtcattcttggaatctgccaggtgctgatagaaagtggtagcaaagcgggaattggccttggacagttcccagacacgccggttggtggcctccgggatcttctgttctgagccctcatcctcagttgccttcttctccggggagcggtaaatgcacatgggattcatgggaatgtcccgcggcttggctgtgcagatgtccacagggctcccgtgacaggtcacgcagtcccagaagccaatgagcagcaaggacaaaagataaaccttcctgcaaggagacaaaatgccaagttaagctaggctgcaacccctagccccactgcccaccacagggttgccccagtaaagcagaggattccagcccacctggtgtggccaagagaaaggctaaatcctttgaaccaagtacaggggcccgggacaggttcagtcctagacttcttgccaggggacagttcagttgcctggacgtggtcatgttggaattagaatcatctgatggttatttggagtattatgtgctcaattccccacgctgggagaaaaaagaatgagaagcttcctgtttgtgacatggaatgtgcatgcctaaaaaatcggctttagtgcccagtgaagagtcagggtggtagggggagccatctacagaaactgtttggggaaggactctgatagatgcagcagagagatttcagcaacacaagagaagtaagaagaaatggatggagcaaaggcaatatctggccgggtgcggtggctcacgcctgtaatcccagcactttgggaggctgaggcatgcagatcacttgaggttgggtgttcgagatcagcctggacaacatggtgaaaccctgtctctactaaaaatacaaaaattagctgggtgtggtggcgcacacctgtagtcccaagctactagggaggctgaggcagaagaatcacttgaacccaggaggcgaaggttgcagtgagctgagattgtgccactgcactccaacctgggtgacaaagtgagactgtgtctcaaaacagcaacaacaaacaaacaaacaaacaaaaacaatggcaatatctgtgtgctgaagattcctacatctctagctccagccctaacccttccactgagctccagactgactatttgctggacagttccaccaggaactcctacaagttcttcagggaaacaggaccaaactgaactggtaattaattctcccccacaggcctgctcctgtgagtgggctcagtgaatcccgtacagaaacctgagaatcaccctggattcctccctctctcctcctcatttagtcaaaccccagagtcaatcagttcaccccagagtcaatcagttctgtttttttactctttcaccagttattgccactgctttagttcaggctctcatccctttttattgcctggaatttttaatagtcgccaacatggattcaatgaaggtaaatgaagctaatttcacattttaaaaaaatgaggtagttgggacactcgatgaagcaaatcaagagataaagtctcttgtaatattttttgtagataagacagggtggggcaggggctgcctccagctggtttatggttcctgcgtgtacacaagggggtctgtgtgtgggtactggatcttcccatcttctcctgggagagaaagacaggcacccagtgcagattcacggacgtggtccgttgggcaagcctggggctggctggaagctggggcagctgagggggacttgccttcttgcgtggtctgagtccagttctgcagccctttcaagaacagaggtgcaaagccggagagaagcagcggcaccaagggagatgtggaaggcaggctgaagaagcagagagagagaggagaggaccctgccattcatcttcccatctccactgccttcggttgcccactctgtccttcaactacatttggaaatgcaatttgaggctgagaggaccctgggagggctatgaagcacaaattaaaaccaagacagttgtgccaccaccccgtttctagcctcctgtgacaactcagatgaagaagggagtgtgtgtggcattgagggagggacaactctcattgtgagaaaaggaagcagttttggccctttagtcaaaggtcactgggatttgggtgggggtggagtggggtggatctgagtggaagaaagagcaaaaagggagtgaggaggtcctcatgggtagcatttgctctcttcccggatggatggcaggccctggggattccccttggagcgtcccctggatcccgtgagtgctgacttcctgcacagcatctttacaccagggatgacatcccccttgtttcttaggctagggacccaaggggtagcttaggaaaggccttaccccaagaggtggggtgggagggagagcacttgaaatgacgtcttccaaacaggtctttgactgtaactaccagggagagggcctggtcttctcaaaggtgttggaggtcattcctgtgagtcctttggaggtcacaaaacccagtaggggcaggcaaggggaaagctcacccctcttacctttttccagaggttacagttcctatcacattggaatacatggccgctaatcttccacagggctgggcaagtggagatagtgtgatctgaggcaatccgcctgaaaactggttctttcctctaaatctcgcagaggttccagaggacagggtggggcagagagctggtcaggagggggaactgaggtcaaaggctgatgaccagttcccagggttaagcaaagtgtagagcccagtgttgtttaattagtagagaagttttaaagttcaatcaggcccagggaaagcctgagccacctctcttgcccacactccctcactcttctcctcagctttatagaaaaggaaaaggagagtatgttcataccctcaaacttggttaggaaactaaccaaggaaacaaacttggttcatacccaccctctctcatagttttctttatggagagagggagagagagagagaaatatctaattagagaaggcaaagagggacaagctgctaccttcaggcatctgagtgccaaggtgtccctggcacagacaaggaaaacacaatggttacacctgtggcccacagagagacccattccccagcagccctgaagtggtgggacagggagagaagagcagggcctcggggtgcatgccaagcgcgtttctaaggggtgtgagcagctgggaaatacttagcaaaactctactgggggatcaggagacagaatgcggggcaggtgaaaaacccacgtacaactgctgaaataaaaacaaactaaattatatttatgtgtatcgttatttttattagttattggggagattgggtaaattcaaactagtggagataaagggcaggtttgtttacatttccctcttctgaaatagccaaaagcaccatcacaaggactgcagccaccaagttcacagggcgcatgtgcctcctgctgtgtgatcaaggactccttgtagttgttgttgcagtcataggcattttcgagagctcttcgttcatgagagaggacatctctcctgaactgaagctgtgtctaagttcttggctgattcagaccctggatcctttgaagccctccatgtgcagtgtgaacagtagccgagaactgtcccaaagggccccagaatgcccagaggctcatctgtcaccctagattaaagactattgaaaagtctcctgttcaaccacttgagttcaacaaatacacgagtgctgcttgtgccagcagacactgttcttggggctgggattccattcgggggagacatacagcaatcacataaagaatcagtattttaggccaagcgtggtggctcacacctgtaatcccagcactttggtaggctgaggcaggtggatcacctgaggtcaggagttcgagaccggcctagccaacctggtgaaaccccatctctactaaaaatacaaaaaatagctgggcatggtggtgggcacctgtaattccagctactcaggaggctgaggcaggagaatcacttgaccccaggaggcagaggttgcagtgagccgagatcgtgctattgcactccagcctgggtgacagagcaagactccatctcaaaaaaaaaaaatcagtatttaaaaaataaatatgtaacgtgccagtcagatgttaataaggtccatagagaaaactatagcagggcaaggatataggaagcagtgggaggaagtggggagggcaccatctgagaacacttggtaggaaaggcctcccttaggaatcattgttaggaaaccagaatgaaatgatggagggggccatatgaatatctttaggaagagctgtccaaagagaaatcagaaatacaaagaccttgaggtttcaggaacatgctgttgagacctattgttccagcttataggagttatgaggtttgtgtcttgccaagaaggtccttgggggagggcagatgaggggccctgcaaaaatataggtgatttggtgaacatcgctggaaaagattaggatgcagatactaccaggtcaaggaattaagaactataacatcagggtttgtgtttaatttgttcatccaggctggatgcagtggctcacatctgtaatcctagcactttggaaggccaaggcttgaggccaggagttcaagaccaactgtgagaccccacacacggtgagacccccatctccagaaaataataataataagctgggcatggtggcatgagcctgtagtcccagctactcaggaggctgaggtgggaggatcacttgagcccaggaattcagactgcagtgagctgtgatcacaccactgcactccagccttggtgacagagtgagcccctgtctcaaatgttaaaaattaaattatatatatattttaaaagtgttctgccaggcgtggtggctcacgcctgtaatcccagcagtttgggaggctgaggtgggcagatcacttgaggtcaggggtttgagaccagcctggccaagacagtgaaaccctgtctctactaaaaaataaaaaaaaaattagctgggcatggtggtatgcacctgtaatctcagctactcaggaggctgaggcaggagaatcacttgaacccgggaggtggaggctgcagtgagtcgagattacgccactgcactctagcctggatgacagagcgagactccatacaggtgtaagccactctgcctggtgcatattcttttcttcttcttcttcttttttttgtttgagacggagtctcactctgtcgcccaggctggagtgcagtggcctgatctcagcccacctccaacctctgcctcccaggttctagagattctcgtgactcaacctcccaagtagctgggattacaggccccttccaccatgcttggcaattttttttgtatttttagtagagacgggttttcaccatgttggccaggctggtctcaaactcctgacctcaagtgatccgtctgccttggcctcccaaagtgctaggattacaggcatgaaccacagcgcccagcattattttcaaatatagtactatttaaaaatctctaaaccttattctaattttgccaatcatccaattaatgtttttagagactggttgtcactctgttgccattagagatgggggtcttgctctgctgcccacactggtctcaaactcctggcctcaagcaatcctcctgcctcagcctccccactagctggaattacaggcaggagtcaccacacctggttttcaaagcaatggttttcaccttctttgtttcagaatccttttatagtcttgccaaagaacatctaaatattattattaaaatagttacatattaaaatagttttggccaggctgagtggctcacactagtaatcccagcattttgggaggccgaggcaggaggattgcttgagcccaggagttcaagaccagcctgggcaacatgcgaaactccatctctataaaaaaatgcaaaaacttagctgggcatggaggtatgcgctggtaatctcagctacccaggaggctgaggtgggagaatcacttgagcctggaaggttgaggctgcagtgagccatgatggcaccaccgcactccagcttgggtgatggagtaagatcctgtctcaaaacataaataaataaagtgaaatcgtttcgacttcatatacctactgaaaggttttctgaatctcctagggtccctggaccatgctttgggaagcactgatttatagccaataaaaaaaaaagaaaagaattttttttctcctttccctggggcaggagcacacattgcatttagttgtcatgtctctttagtcttctgcagcttggaacagttcctctcgtctatggtcatactaccctgaaagtgcttgatcttagaagctaagcagggtcggccccggttagtacttggatgggaacagttcctctctttttctttcatgattttggcttgtttgaagcatataggccagttaattttgaagactgtctctcaatttggtatgtctaaaatttcttcaggattagattcaagttatccttttcggggcaggaatacaacagaggtaatactgtgtccttctcagtgtatcgcatcaggaggtacagatgttaatttatcccatcactggtgattaacttggattacaagattgtgtctgccaagtttctctgctgtaaaattacaatgtttccccttttgttaaatgtcttgtggggatacttcacatacttgagagtatgcaaatatattgttttccatcaaattttcacctgctaatttaagcttccctcaatgatccttttgcaagacttacaaaaatttttttaattaatctttttttctgagacatggtctcactattgcccaggctggagtacagtgacaccatcttagctcaccgcagccctagacaacttgggctcaagcaatcctcccatcttagtctcccaagtagctgggactacaggtgtgtgctactgtgtctggctatttatttatttattttgagagggaatttcactcttgttacccaggctagagtgcaatggcgcagtcttggctcactgcaacctccacctcctgggctcaagcgattcttctgcctcagcctcccaagtagctgggattacaggcatgcaccgccatgccctgctaatttttgtatttttagtagaaacggaatttcaccatgttggccaggctggttttgaactcctgacttcggatgatccgcctgccttggcctcccaaagtgctgggattataggcatgagccaccgcacctggctttatttatgtatttttaaaaactttttgtacagatgggttttcgccatgttgcccaggctggcctctaactcctgagctcaagtgatctgcctgccttggcttcccaaattgttgggattactggtgttagccaccacatccagcccctgcaagacttttaaagcactcctccctccctgttatttccatgtttctctaaaaaggattatcacaaaaaccattagaattaaaagagattaagttagacaagacactaggctgtgaggaaacaagctgtttcatcctttgctcttcggggtacaaagtgccataagtctttgtaggtgctttgtagggaaacatggaaacaccaaaattacaaatgcatgtaccctgtgaatcagacattccacttcaggaaattcatcctacagctacacctgcatgggtttcagcaaggttagctgccatgacctgattcataataacaaaaagttggacaccacttccatctgtaggagactggttaaataaaccaaggcacatccccacaatggaaaactgtgccattgtgtaaaagaatgaggatgctctatatggatgtactgatatggaagggtccttaggataattatgtggggaaaaagcaagctgcagaaagtgtttatagtatgctgtgctttttgtaacacaaagtgaggatgatggggtgaggggtggctagagacaagggtaggagtagacttatcaatatgtaccatcttatttagttttctaatgttgaacatgtcaatgtatcacctattcaatatgtcttgactttatgacacaagggtgtcagtgttgtattcacacagaggcttggggagagaagaggagcagggcaggatgagggcagtggcagcaccaaagaggaacctgaggcaggctgagtgcctggctggtgacaggggagaaaaggagaacgggtctgcaggtggaaagaggtgtttaggtgtgccctgcctgtgaaagtagtttctaatggctgtataatattcagtagtctagaacttaaccattactttagtgttagacattagcctaggtcagactctttaaaagtttgaatatgatttatgatcatataggtgccatcttaataggtgctatttaaaaacactatatatcagggtctatactaaatgcttcccaggcattagcttatataattctctcatcagctctaccagaaagatactaattatgcccagtttacagatgagaacactactatttacaagagttatttgccccaaattgcaaagctagcagagctgagattcaaacctccctctgcttctctcaaagcccttgtgtcccagcacgatagatatgaaagaaatgcccaggacttcccatgttacaacccacagtgtccaactgcttttcatctggttctcctctggatagtctctgtcaaacttgttcacaattccctccaaatccagtgcccagaaatgaacccagggactaccacattttcctttgcctctatctctctctctcccccacccctctctctctatatataatatctatatataatatagatataatatatatacagcctccacagctgggactacagtatgctccaccacacatggctaatttgttttttgtagaatcgaaatcactatgttgcccaggctgctctcgaactcctggtctcaagcgatcttcctgccttagcctcctaaagtgctgggattaaaagcatgagccaccacagtcggcctgtctatccatattttatttgatgcacatcccaaatgagcatactcacaactcagcctgggcattcagcacactagctctttctttttccacaggtcggtctataagccacatgatgaagatgagactgatcctaagccctggaagttatcagcccaggtattccctgcctctcacctcttggacccagcacatttgggaaactgagatcccatgccctggaatgaaagaaacggatctataatcatgtttccggaccgagaagccatgtgcctcattctgtcctatccaacattgccatcagtggtttggaggaagacacagtcaggaaacagtcaagggatagtgggtgcagtgatcatctgctggatcccgggctgcctcgccctctccactatgcttctcctgcaggtctcccaagagttctcattggtctctgggagactttaccaccagcctagtctctggtactcactgcacacagctccccttggcttttattatactatcaaggtttggatgatcccagatccatttcctcttggttcatcttagactgtttagactgggaaagaaaaaaagagcttgtatgctgggcaaactaatttgtgactgtgtgtgtgtttacacacacataggtattctgaaaagtattttttgtgtatatttaaatataataaagatattttaggttgggcatggtggctcatgcttgtaatgatttgggaggctgaggctagaagatggcttgaggccaggagttaagaatagcctgggcagcatagcgagatcccatctttacaaaccatgaaaaaattagccgggtgtggtggcgtgcacctgtagccatagccacttctttttttttttttttttttttttttttgagatgcagtctcgctgttgctcaggctggagtgcagtggggccatctcggctcactgcaggctccgcccccccaggttcacgccattctcctgcctcagcctcccgagtagctgggactacaggcgcccgccacctcgcccggctaattttttgttttttcagtagagacggggtttcaccgtgttcgccaggatggcctcgatctcctgaccttgtgatccgcccgccttggcctcccaaagtgctgggattacaggcgtgagccaccatgcctggccagccatagctacttcttaagtccaggattttgagtctgcagtgagctatgatcacactactgcacgccagccttggcaatagagcaaggccctgtctctaaaaaagaaagaaaaataatttttctttaaattaacgttttcatggaaatttctaatatttctagaactggaaatattagaaagagatagacatcttaagaacttttatcacaaaaaaatcagtttttgaaaaggactccctacttctgtgtggcactgtttttctcaattctgagtgaaaagattggaaggcttgtgctttgctgtgttaggagtaggttcaaggaaccatgaagaggagagaacatagcagttgattaccctctctttttttagtacttccttcaagatcagtgataaaattcctctttccctagccctgcttccagttcagtagtaacttccatgagcaggtaattcagcaggtccatgtccattgcctcataccctgggctgttctgttctttcctttggactcaagaataagaccttggcagggaagagataggacccagcttctgctgtggttactgaataactcaaagcttaacccttccatggaaatttggcaaaacatttagcacaaaaagcagtctccaactcccttgggttcccagtttactaggtgaacatgacattttaattaaggtgaaattaaacttaccaaaataaatcctacattatcatttagcagcatttagctgaggctctcaaggcatctcactggaatttgcccaaatcctcctgttagaaagttcagttttggcttcagggaaaccaaatcaaaacagcaaatatttattgaacatgtcctgttgaatgtaccaagtacttgataaacattcatgtttgaaaaaatccaggtccagagtagttctgctaacttaataacaggaaatatagcactttaaattcctcccaaatagaaagtttagattatcaagtaaggtgaaaaatgcttactcatccagaagaattgacaccttgtatgaacagaaacattggacaaggctattctttggaggctgagcaagagagagttgtgtggggtcaaagcttgttgcttttatattagtttgggaagttgtaggtggtgaaagagaaacagcaaagggaggctgggtgcggtggctcacgcctgtaatcccagcgctttgggtggccgaggcagtcggatcacttgagctcaggagttcgagaccagcctggccaacatggccaaacaccgtcactgtgaacaaaaaagtagccaggcgggtggcgcatgcctgtagtcccagctacttcaggaggctgaggtaggaggattacttgagcctgggaggttgaggctgcaggaaattaagtatgggttaaggagatgcatcactggtgccaggctgacaataggtagacttgtggacttaatttaggtatcaccttgactggataaagggatacctagaaacctgataaagcattattttggatgtgtctgggagggtgtttcccaaggacatttgtgtgtgagtctgagtggactaggtggagaaatctctgagagccgtgacagacttttcttctgctgccttggacattagaacttcaagctcagtggggcacggtggctcacacctgtaatcccagcactttgggaggccgaggggggcggatcacagtatcaagagatttagactatcctggccaacatgctgaaaccccatctctgctaaaaaaaaaaaaaaatacaaaaattagctgggcgtggtggtgtgcgcctctcgtcccagctactcagaaggctgaagcaggagaattgcttgaccccaggagtccgaggttgcagtgagccgagatcgcaccactgcagtccagcctggtgacagaccgagattccgtctcaaaaaaaaaaaaaaaaaaaaaaaaaagaacttcaagctcacaggcctttggactccaggacttaaaccagagactcgccaggtcttgaggctgtcacttccctggttctcaatgtaaaaatgtttaaacttcttcaataaatgaaggggtttttttgtatgtctgtatttatgaaaggtaaaatttctcaagatctcaggttttgggacgactgtatatgcagtggtgacccattgtgtgtgtgtgtgtgtttgaagcagggtctcactctgtcatccagactggagtgcagtggcaaaatcatggctcactgtagcctcaacctcctgggcttaagcaatcctcctgtgtcagcctccccagtagctgggactataggcacaaatcatcatgaccagctaatttttctattttttgtagagacgaggtctccttatgttgccacactggtctctaactcctaggctc

SEQ ID NO: 474 - DNA, 28554 bp, Homo sapiens
acttatttctggttcctaacagatgtatgtcttatgtgatgcaaaattattctttgaatggagattttttttcccccttcaagttcatggattttctttttgcctttgggactggattgagagaatgggaaaaatgtagatttgactatcaaatctaaaacaatggccttgggttaattgctagccccttggtactttctttaaaaacttttaaattatgaaatataacacatataacaaagtgagtaaaatgtagagtagagctttatttttatgtttttagagatagggtcttgctatgttgctcaggctggtcttgaactcctggcctgaagcaatcctcctgcctcaacctcccgagtagctgggattacaggcatgactcacagtgcctggcttattgttttacagcaaaccctatgtagccgttgcccagatcaagaaaagaccttgatagtccccccagaagcctctcatgtcccatctcaatcaaagcccctaaacccccatcagtaaccactatctgaattttcaaggcaactgcttctattctttatgtttttttttttacctttactacgtaagtatggatctctaaacactataatttagttttgtcaatttttgaactattacagaaatacagtattggattatattttgtgtctatctttcactcagcttggttgtgagattcacctatattgttggatgtagcaatggttcccttatttttattgctgaatattcccaatactgatggcatttagattgtttctaatttggggcaactacatatgatgctataaacattctactcgtctcttgatgcactggggcatgtgtttctgttggacattaacttaggagcggaatttcccttattatctagtaagataattccacagagcagtctggaagtgtgcaaatggcaagtacaaatacaatccaaattaggttctgagggcgaatgggactaaccagaggtgcctcaaaggaagtcagattgagagccataggcaagaggatggctaagcagctgtgcagtcctcaccttcagcctgagcagactcattcctttgtaattagattttgtttggagttctgctgtaaagtttgttggcaatatggcatacaggaattacgtggctcatcacaagtatataattaatattagttgaattagatgattaatttagaagtcagcaggatgatctgaaagactaaatagggtgaccacttagtttattatatttataatatttgactgattatgaggacttcacacactttggagcaggataatggaaacagaaatatacagatgttatttctagtgcccaaactgctagataggttggaggaagggtcagtgttaggacatggatacttcacaaaggaaatatcgctgggcagaccatgtaatgagctgagaggaatattataagatggttgagagcattttttccattctaaaatgaagtaaataatggaacctacttttcaaggttgttaggaaaattgaagtagataatacaataaaagtcttggcacagagccagtaataagtgctccgtgttagccactgctgttggtaattaagattgactgtacttagctagcagtaaggagaacctgctatcagctttgaaagtgtataagaaaaagatttctggaaattatttgaaaaagcaatactacaatgataattttagaagctataactccgttaggcaagagtgtaaataaaaatcttgttaaattaagtatacgcatcctaactttaccaacagctgggttcctacaagaggttgattgcactgtgaactactgtgtgaacatcctggaaatgtctgacatcttgtctctgaaggtgctgttttgccatcttcctagtgcttagtgggctcaaaattccagataatgtggtagattcgaatttgaaaacaatgttaaaaagagttacgtgtgtgtacaaactatcaggtgctgttgatgtttcagagagcagggatagaatccaaatggctttcaaacaagctgtgatctggccaggcatagtggctcacacctgcaatcccagcattttgggaggctgagtcaggtggattgcttgagcccaggagtttgagaccagcctgggcaacatggtgaaacctcatttctacaaaaatacaaaaagtagcatgatagcacatgcctgtagttccagctatttgggagactgaggtgggaggatcacttaaacccacgaggttgagcctacagtgagctgtgatcatgcccctgcactccagcctcagcgatagagcaagactgtctcaaaaagagaacaagttgtaatctaattaattatgttattctaaccaaacagctgtgatctgcaggggatctaaaaaagttacatggtttgcttcttggctgcacattagactccacctgggagattttaaaataccccatccccagagacagatataattggtctggggtgggcctgtgcttgtgcatggccttttataaaactctctatatgaccctaagtaggcagctagaagttaagttgcatttcagggatgcaacagggatgaaagcagtgagaaaacagtcctggttatataggcaggaatttccccaagtaaatgtggaggaaatttcaagacattcccatctattatctcaatcctcagtaaccctgcaaggtagataggcagcacccctttttataggcaattcaggttcagagatagcatactggggccctctgtgatacccctgcttatcaccagaaatggattatcttctgtggtactcacaggattggtgggcagtatgctcagctagttatggtttgggaagtccactgcttcatgactaaagcatttctcaccccacaaagccagtgcgtgctgactacttagactagaactcatcagttgccagggaagttaagctcctccctgaggagctgagtgtgaggagccaccagacacttgcccatcacagtcagatgctcaagcatctgagaactcagaccagttctggtgtgggaaactttcagctcttcagcctagagcaaagccttcaccccgtctctcaccctcataccacaagcagtgaggcctgcaattttgaagatagtttttctgatcatgcaatttttattaactgtgtgaaatttgggagacaaaagcatacaggggaaaaaatcctctattacccagaaacaacttctattaataatatgtatttttttgccttaaagtttttaaagaaagttaggataatggtatataatttgtgtcctattattttttctccatttagtattaaaggagtacattcttccatttcccgccccccggaaacatttaaaatagctgtaaaatactttcatatgaatgaaccatagtttatgttaaccatccctctccagttttccactaatactggaaagaaatatgtggaccaggatgtttatattatgaaaagaatatataatccctttaagtttctttatacatattttcaaattgcctttcagaaaaattgtacatatttgcacccctctgcccacagtagtgtttgatcgtggcactcttgccataattggaaattatcaattcgacaaaacttaaaacactgttgtttaatgtttttgcttgaacacttcttaagtaagtttttttgtttttgagacgacagaatttcgctcttgttgcccaggctggaatgcaatggcgcgatcttggctcaccacaacctctgcctcccaggttcaagtgattctcgtgcctcagcctcccaagtagctaggattacaggcatgcgccactacgcccggctaattttgtatttttaatagaaacgggatttatccatgttggtcaggctgatctggaactcctgacctcaggtgacctgcccgccttggcctcccaaagtgctgggattacaggcataagccaccgcgcccggcccacttctcttgttctaaccgcttgtattgagccattgaaacattttgagcactcatttcaaaatgcaaatctgatcatgtcaaacacctccagtttaaaagcttttccttacaaaatatgctgccaaaaaactcctcccaatcttcattccagccattccaggtttagagatgccatgctatctctggctagacccactcttgccccattccctctgccagctcatcctctccctgcctagctaccgtttggctcttagctgaagtgtcaacccccttcccaccccaagggtcctccctgaccaatcttagattttataaacccatcagattcttggagcatctggttgtcctatttgcaccctcatcagttatatatgtacctgttttccccaccaagcatatggctccatgatgatactgttttgctctctcttctctactgtgtagcacacacacaggctggcattatctgttgaagaaatgatgtggaataatttgaccaaaactgtactattggatgattagtctatagtttctgagatgaaactggtttccgcagaatttaagtaagagttaaaactactgaaaaaagtcaaaggtaacatggctggaaactggagctggagtttattgtaaaggaggaattgatgcacaggagatagcaactgtttgagaaaatgaaaacagggtgagaaaagcaaataattcactaaagatggcttcatggttaaatgtttaatatctccaaaataggaaatatgggagtgctattaaaaagtcaaaaatgaggccaggcaccatggcgcatgcctataatcccagcactttgggaggccaaggcaggacaattgcttgagctcaggagtttgagaccagcctgggcaccagagcaagatcctgtctctataaaattaaaaaaatcagatgggcggagtggcctctgcctgtagtcccagctacttggaaggctgaggtgtaaagatcacttgagcccaggaggttgaggctgcagtgagccaagatcatgccactgcactccaggctgggcaacaaagtgagactgtctccaaaaaaaaaagtaaaaaatgagtggacctgaatagacacatgataaatgtctcttcctctcactttccccatgctgttttcacttctctctatcagctatcattcctgcgttactatacaaatgttaagtttatgtatgtgaactcaacaatgtaacatcccgaagtctagcatggactttgatgtgaatcttggctccattaagtagctgtgcaactaggtaactcagttaatcctttatgcatctcaattttttcgtcaaattactagaattggttttacaaatgaaatgtggtaatacatatgaaatgtttgacagaatgcctagcacatactaaaagcttaatatggtaatatttaccgtactattccttttagaatactggggtaagattaaacctgacaagacatcaagaatctaagaattccttatacacagtaggcatgcattgtttgatgaacaactgaatgttcaataagaccgatgaacaggccactggctcatgcctgtaatcccagcactttgggaggctgaggcaggtggactgcttgaatccaggagtttgagaccagcctgggcaacacagcaaaaccccatctctacaaaaaatacaaaaattagtcgggcgtggtggtgcacacctgtagtcccagctactcaggaggctgaggtgggaggactgcttgagcctgggaggttgaggctgcagtgagcagtgattgtgccactgcactcttgcctgggcaacaaagtgagactcttgtctcaaaaaaaaaaaaaaaaaaaaaaattgttcagcgattaagtcacaaagaagggtgttcattaaagcgttgtaatagccaaaacctgcacataacttaaatggccaccaatagaggaacatgatgtagccattataaagaacatggcacatttatatgtactgacattagaatatatcttcaatttattaagggaactagagatgcagaacaatttacaaaatataattctatgctgggaaaaatgatctgtgcaacctgctttcctgcaactttacaaaacattttgttgttgagacagtatcttgctctaacacccaggctggagtgcagtggcacaattttggctcactgcaacctctgcctcctgggctcaagcaattctcccacctcagcctcccaagtatcttgagaccacaggtatacaccaccacacctggcaaacttctttattttttgtagagacggggtcttgctatgttacccagactggtttccaactcctgagctcaagcagtcctcctggcttggcctcccaaagtgctgggattacaggcaggaaccaccctgctgccaagttaaaaaaaattttgtaaacggattaaagagtttggaaatatatacaaacctctgtagtggttctctggatagaaaaatcagcttaagaaaatgaagtttcacagtatatgtaattcaatttttagaaagtatgcatcatgtatgtttaattacatttaaaagattttttatgataaaatattctagaatcccaagaaaatctgaaattggtagagactgtttatacgtcttatttatattttactaatttatattcataaaagtaacttaggccaggcacagtggctcatgcctgtaatcccagcactttgggaggctgaggcgggcggatcacgagttcaggagatcgagaccatcctaacacggtgaaatcccgtctctactaaaaacacaaaacattagccgggtgcggtggcaggcgcttgtagtcccagctacttgggggctaaggcaggagaatggagtgaacccgggaggtggagcttgcagtgagccgagatagcgccactgcagtccggcctgggcgacagagcgagactccgtctcaaagaaaaaaggcaacttaatatccaacagtggaggattcttttactggtacagtcacgttatagactactatacagccactgggccaggtgtggtggctcacacctgtaaatcaagcactttgggaggctgggcaggcagatcacttgaggtcaggaattcgagaccaacatggtgaaacctcgtctccactaaaaatacaaaaattagccaggcgtggtgtcaggtgcctgtaatcccagctactcaagaggccaaggcaggagaattgcttgaacccggaaggtggagggtgcagtgagctgagatggcgccactgcattccagcctgggcaacagagcgagactccatctcaaaaaaagaaaaaaaaagagaatattatacagccagtataaatcatgctgtaatttttactaaaatggaaagttctcagtacgtcaagtgaaaatgaaaggttacaacatattatgtgcagtttgcttggcattagttattacctttggtaggattacaggtgatttttctcctttttcagtctcttcttttacacatttactaaagtttttctaatttcttacaataattatgtaatcaggggaaaatgccattaaaatatatgcttatagctaactctaagcttgctttagagcttgggtattacgtaaccatgatgcgaatgactggtacaaatccaagtaacacttcaatacgtttgtaagggattataattgaaaagtcaccattcccctggaaccttaataataaaatgttaaagacattagtttatcaaaagaatttattagaaaatattacacactacatacatatttatttaagagtataatttcagtagacagcactccaacttcataatacaaacaatatctcatggaccctggggcaatcactgtgcttctgaagctacatcttttggatggaacattccagcagtacacactgtggccatttaaaggaaggtaagagaaaaaaatgtgataattaccaaaacaaattttaaaaagcacaaaacttttggaatgttaatggataactactattagtctcaaaattctaggcatttctataaaacattggtcaatgtgactagtaagttaacgggaccaaggtttcaaagatcaatactgaaccttgataaataataagaggaaatgtaactccacaaaatgtttctgattaagtttgtgcccatgcaaaattaacataaatttcttaactcaagaatgaggaatattaaagcaatgtattttttcaacataaagcatgcattttctaatacattcttaaacatttcaaaattttaaaagttcgaattctaatcaagtagctattaatgcagtctaaccagtgccccaaatcagacatggaacacacacttgttactgtcacggaaataattcatgggagtgctactaaagatatatgagacttcaactcttgaccacatcactttttctccaaaactttagaacttgtttgcaaaagctaaatggtataaaacacattttaaaatgtcacccaattctcaaatgtcactgaaagaaaatgcaggaaaagtatgtattgtgtgattaatcagcttaggcttaactcaaaatactttcaatgttcacaaaattgtttctagagttctaatctaaaacaactaaggaggtgtgccttgatattctgaaacactgtcttaatactttattagaagaaatatgcttgaaatttctttaccataatctaaacgcaaactttaaaaatatataccagtagaataccatattacaaatgcccagaaatgtagaataaaggtcaaaaactgcttggaaatatttttatgattacactcataacaacaaagcttatgaactagcacaatcattatgggaccaacatttcaaaatattttgcctatcaaagctagcaccaggaaaagtattatgcacataaaattgagaaacagataatctttactttagaaaagcacagttctacagagtattgctctggctaaatagtttagctagtaaaaaggtcagtttatctcactgaggcatgtatctccttggatctattaacttatctgaagaactttccaggtacttggtatgtactgaaaattcttactggaatcagtttatcatggagaaaacctactgttctttcaagatgccagttaaaataatggcacaataaacattttaaacttaccttttataaaaactgagatattctagtattaaaaagagaaaaaaaaaaaaacccaaatccctaatccctgaaaggctaaccaggactccattatttaaatttcccctctgtttctaaaacacaggttttactgtctagaattttgcaacatggctaatggctaccacctggtcaccaaattaacacttcattcattgtaaagcatttggggattttcaagtgtgaaaatatttcatcagtgattagataaacaacaactttacgccagtgccatgagtcttgtaattcttagccccaaggaagggaggataacagcctaacagcaattctcgaattggcacaaataatttatcgtctgcaacgggtagaagaagatactatgaaagaacataatttctacaaagtcaacacttttttttttcttttttttgagacggagatttgctcctgttgcccaggctggagtgcaatggcatggtctcggctcactgcaatccccgcctcccgggttcaactgattctcctgcctcagcctctcgcatagctgggattacaggcgcccaccaccacgcctggctaatttttgtatttttagtagagacgggatttcaccatgttggccaggctggtctcgaactcctgacctcaggtgatccgccacctcggcctcccaaagtgctgggattacaggcgtgagccatcatgcccggccgaaagtcaacaatttttccaaatctttttcctcaaagtcttcaacaaagactttgaactgccaaagttgtaatctagtaagtcaaactgcttatctcaattaggggtaaacaaaggcacaaaagaaaaacaagcagcataacctttatttggtcatacaataggtgaagagtgtctcaatgttttgaacactaaattttactcgtgataattttttttctatctaggcaatttattcagatatgtgctttaaaaatacacattaggaactttgcaactgatatgttctatttaatattagaaacatttttcatggtaatacattatttaactttctataattagagggaaaaaatcataaagatcatactttacattttaacctgacagaataaatgcattatatatatctctttgaaaaccagtgcacttagaagtttctaatttatgcactccattgccctaatcaaaaagctatacattttccagtatccacactataacacagtcctagtaaagatgcacattcctttaaaccctttactttcccttgaattttgtgggggagggtggaggggaaggaaggatacagaagttgcagtgcagacctatatttatttagaacaaaacatcatatcctatgttaaaaaaataattttatcaaaaccaaatttcaatcacagttatgtatgattttcagttaatggtacatgttgaaattgcactttgcagatatcctgataatgtccttgacagcgttccccatttcagcctatgtttttttcagtagacacaggttcttccagagttttcttttggctccccttccgtgaatatttgtatttgtctacataggctttaaccagatttgccactttagtagaatttacttctccactcttactatgacaaacctaagaaaaaaggggtggggggtaaacttttttcatgcttaaagggattaaagccaaaatagaaagctttgtgaaaaacaaccccaaagagataaccagacttattttcatgtttcattatctcacacaaactaatcaaaaggcaaaaaagtagacaggaattagtaggagctagcttttattattttaattaaacttcagcattcatttattaaaacagaggtggttcaaaacaacgtgcacatactccactaaagccataacttactttatctactgctttccgtacaatttctttatattcttccttggtgatatctttattttggtaaaatggcttgatggccaattttacctcttgtgctgctttttcttgaatttgcaatttctgatgagaagaaaatgtataatttattatttgccagtcatactgctctcacaaaatcccaaacaagaaattgaaaatacttcatatttacaataagagactctccaactattaacgtgacaaatataaaacagtttatttactaaaacatatcaaacatttctaaaaacaattataaaatattaccagtaatttactggacatcaacacatctagagagaatccttcaaataataatggcatttagacagccaataagaaattcccttcaccactcatacaataaaaagctgatattttttctcctttatcatatacagaattatgaaggttgctctcaaccttgaacttgccttgtctgtcttcgagctatctgcgctggcttccactgcaacacttactttgctttctgccaattttacagcagcattagaggctttgctgtgacttgatgacgaagtattaccagaacttggtccctgaaccattcccgtatttcctggggctgctgtcggagcaggcaaaactggtgtactcatgttattacttacatgagaagaactaggaataccctgttttaaagagttatcatcagttaatgaattacttgtactcgatagaagtcttttagtgatgcattagaaataacattaaaaaacacaaagcaaaccaaccttagtactaaagaaaaatgcatatttcaggtaattatatctaaagggccctttaaagaaaaatgagtaacattcttaaacggggccttatttagatatgtcaagatgacttttaaattatatatatgtattgtaacattttgacagcaatactaaacacaaggaggagaatagcatttaaagaattatatctttcctgcaaggatctttaggaatattaacaaatattaaagtgccctcactttaaagcctggaaaaaataaggcagtaaagtcaaatggcttgtagtaagttgacaggagaaaaaaggcttgcagtaagttgacaggagaaaaagattaagatcccaaatactaaaatccaatttccctattccttcaactctatcttactgtcaggattctatttattttattttattttaattaattatttatttatttagagacgaagtctcactctgtctcccaggctggagtgcagtggcgcgatcttggctcactgcaatctccgactaccaggttcaagtgattcttgagcctcagcctccgagtagctgggattacaggaatgcatcaccgcgcctggctaatttttgtatttttttttttctagacagagtcttgctctgtcacccaggctggagtgcagtggtgcaatctcggctcactgcaacctccgcctcctgggttcaagcaattctcctgcctcaacctccttagtagctgggattacaggcgcttgccaccacacccggctaatttttgtatttttagtagaggcagggtttcaccatgttggccaggctgatcctgacctcgtgattcacccacctgggcctcacaaggtgctgggataacaggcgtgagccaccatgcccggcctaggattctaaaatttttaaaaggcagtcataaaattataagcaacaaattgtttgcaaattattcaaattttctatgtctcacagaggcacttctcctttctttttagcatgataaattcatgaaaatgaaacacagatggtaatggataataaacagctttatccagtgtttgtctgaacaagacaataaaagcttcatcacagtacttaatcactagttcccaccgtccccatataccccctaaacagtgcaaaacaggggaaaaatgtaaagcacccaccactcgattctaatttggcttataatttggtttacttaatatgaataaaaaaatcctgttcagatataagtaacagcatatatgtagcttggatttggtaataagtatttaattaattttctaatttgggagttggggggttttgagaaggatagtgaaagagggattatgaaggtttaccataactgaaatcaaataaacaattgtttttgaatgccaggatgcctttttttgaacatctgtcatgaacagctaaatgtttacaatggctatattgattaaacttgagttgctaaaaacatacctgcaattgctttccatctggttgtgaagcaatgtagttgacttgttgggatggtgggggagggggtggtggtggtggtagtccctgagatacactggtaggagtggctacctgcatgaggggcactcctgtgtggagatgcaagggtagctgaggatgaatgttaaatggattgcgttggatgttcatcaaaggagcatgaacacccactggatatgggaagatattcataggctggtgttgtgcattcatttgttgctgcattacattcatttgcggttgcatcatatttataggtagctgagaaccatcaacttgctggtttgtttggtcttttaggctagaatctatcaaaagaaaaaaagcttgtgaaaaaaatcatgttataaatctctttagacagagaaacaaagaaccactggttacagtaaaattaaatagcaattaataggctcagtataccaataccaatctccaattgcttaatttaatcctgtcatttctaaataatgtggactgactttctaatgaaagaaaacatttggcgaggcacggtggctcaagcctgtaatcccagcactttgggaggccaaggcgggcagatcacctgaggtcaggtgttcgagagcagcctggccaacatggtgaaaccccgtctctactaaaaaaatacaaaaattagccaggcgtggtggtgagcgcctgtaatcccagctagtcaggaggctggagaattgcttgaacccaggaggtggaggttgcagtgagcaaagatcatgccattgcactccagcctgggcaacaacagagaaactccatctcaaaaaacaaaacgaacattcacctgaaaatatttttaagaataagttcatgcaaaacatacatcaacaatcagtagctcaagaaactgactagttaaaaaaaaaaatcacataaaatttaactactaaattataaggttattcaatttttacatcttcaacagcctttatcttgcaatgttcttaacaagaaaaaaaacaaggaaatataaatctttactattaaaacaatggcttattttatttgtatgagaacaattatcaaaaaaattaaaagtgtacatatctgaaataaacaaattagaggttaaatcctgcataggaatatcccaaactcttctattgtagcaaacagtgctgaaaatatttaagtctttggcaaggtttggagcagaggtagcattaataatatacttatgtagataaacgtacgtgtatatatatttatataatgctaagtgacttgtaaacaactaaggttcagcttattataaaaactacaaataaggatcatttcaactcatacaaataacatattaaatttataattcttcaaataaaacagtatcaataaaccaacaagaatacattaccctgtccagatgtttcctcctcttgtttcatccatccagactgtggacctgaagaatttctgcctcgtcgtgagtagtagttttgtacatctgctggcaaagtctttctcacggcccagctggatgcagatgtccatccagatctatctgctggtgtatcaaatgagaactcctgttcactttttcgcttataggattgctgttccacaaacttgaaagattcactccctgaactgtttgaattccctgagaggggttttcgattttgccaccgattttcattctgatctttataggcaaaactacttctgtaagtgcctctgccacggttgcctctgcctctaccacggttagatacccaaccagaaccaaagtttttattccaagaatttcctgaattttcatttctattttcttcccaatgagactctttcaacttttctggatttctggttcttggatcaggcccagagtttattttttctgttatccaattgggacagtcatttctatgtttgtcagcagaatttggatcatcagcatctagatggatgtcatttttttcttttcttgtattttcattctgtttctctgggtcattctttctgtaccgatcatttcctcgtggacatctccaaccatcatttgcccatcttcccttccaccggggagagtaactatctctgtcaattctaccaaatgatgaactcttactttttgttctacatcttgagggggacctagaatgagatctggacctagaccactttctggttctcctttctctctctctcctctgcccatctctatcactttctcgttctctgctctgggacctggatttttctcctggggaagaatctttcactcttggctgagatcttttgttctctctagaagtttctcttcttggggacagtgattcagatcttctgctttccctagtagtatccctttttggagaccgagactgagattgcctcctttctcttgcaatatccttttttggggactgagaacgggattttttccggcctctggctgactcattcttaggagatggtgattgagacttcctgctttctttcccagtttctcttctgggagatggagactggggccgcttcttttcttgtggagtgtctttgttgggtgaccaagttgtagatggagaatgaaatctagatcttcgagtacgaggctttttggttttatctatggtatcttttgggctttcagatggttgagaaacagtttcaaccttttcatccgcaagatcagaagacggcatattattttcagaacagtgtgtcacagaattttcattcatttgtttaagatcagcatttacagatggttcaacttcagattcattttggtcactgcaaaatgaatcacactccataggtatcatttcattgttgtcctcactaaaatgcttctgaatctgttcaatgtgtgttttaggcaactctgtagatctaggatgttcggtcagcgattcattcttttcttctaaagatttttccaatttggtgttcagaagattattttttagtaagttattttcagagtcttgaatattattgaaatcttcattcccaaaagtatcacatgttgcaattatttctacatcttcagtttcaacatgcccaagcaattgaacctctgggctcttaacagattgtctgtccactgtctgtataatttcaccctcagaagattctaacttggggctctctataagctcctctgtttttagtgtaaaatctttatgttcagtaatttctactagggaactctctgttattttttcttcattaaccactgactctacattctcagataagtcacttaggggacaagatacaggttggtacactttgctttcagatgttaaacatgtaggaaaatcatttggaagatgaactgtacatacatctgtctttacctctgattgtgaaagtccagatatctggtcttgcttttccaatggatcacctcctttttcaagaatattttcagaaatctcactttccaaacacaaaacattagcctctatacctgtattctcgagttttttaacttccccttcctcaccaactagcacaggaagatcttgagcacaagactcagaagatgaagatcctactctttcctctgtatcataatttgcagtatgcttctcactttcttctatttgctcattgcaacttttcaagcaattagcagactggttttctacatgagtctgcacagtacaaatgttactactgtctacatctggttggtgctctttttctaacacaggtgatgtgtcagattctgctgtttcttcatctactgaatcattggaagatgatttttcaggggcagctacagagctccgaagtttctttttcagtaaaggtggttttcttcctcttcttacagacttccgttttggagcctgtcttgtttgcttttctgactcagctgaagagggaacacttaaagatggattactgttacctggggcatcacacccagaattgtctgatattggggatctctgagactgactggctgtttcagctcttgtgttacgtgtagacctccttgtaggagttgtcattgcaggttttcgtcttgatcctctggtatttgatgtaccagaagtttgcttcttttcttccccttcttgagtatgtgctaatgcatatcccttgcaagaagtacctaataatatttaaaaaaaaaaaaaaagtaaaaaatatgttttaagaaatagtaatttggctttagctaattttagcataaaatagtctgcaacagagtgaaactaaatacttataaataaaactattaataaatgcatagctactaacatctgagtaatatgacttattcatcaactttcttaatgacactgaaataagttataactagatttggtccaaatgggcaattttatagagaaaaaaaaaaaggaaaataacttttggtcttgtaactgctacttgcttaattttttttttttttggagacagggtctcactctgtcacccaggctggagtgcaatggcgtgatcactggagcaatcatcgcgcacagaagcctcaacctcccaggctcaagcgatcctcccacctcagcctcccaggtagctgggactacaggcatgcactaccatgcccagctaatttttgtatttttaatagagacagggttttgccatgttgcccaagctggtctcaaactcctgagttcaagtgatctgcctgcctcggcctcccaaactgctgggaatacaggcgtgagctactgtgcccggccatgatctgggattatctaagcaaaaggagagagaaaatggtcaagttatccatgaattaataaagactcaaactatttattaataattaattaacagatgttacttctaaagatctatggtttggatatgaaagcctgaaacagaaaggagacttctaatcagttcctcaaagcctccaagttgtaatttcaaaaactacaacagagtttctagttggaatattttttatttttaaaactgactaacagataaaactgtgtttctcatgtacaacatgatgttttgaagtacatatacattgtggaatgaccaaatctagctacttaatatatgcactacctcacatagttataatttgtttagtgagaacactttacgtccactctctagcaattttcaaaaatacaatatagtcgaccctttaacaacacagggattaggagcaccaacccccaacacagtcaaaaattgaaacagtttttactccccaaaacttaactgttattcaccagactccttactgataacagtgaattaatatattttttatgttatgtgttacatactgtattcttacaataaaagaagctaaagaaaaggttattacaaaaatcataagagaaaatacattataatgctgtactgtatttattgataccctaagtttatatcatttgtttacaagatgaatcatctgtctgaaatggcaggcaactgcagctatagatctcaatctgttcctatcaaggaattaaacttcttcttataaagccataattttgcttcttgggagcacttcctacatcactaatggcacttatgtgggtcccaaaggtgttactcaaggtttacagtattgcactaaacactatgaaaaatatgcatgcactgcaagagatcactttttactgtgatatgcaatctattagaaagacaaatgctcacatggagatgattacattaaaccaggttttgcgttgtgttttgttttttttttgtttttttttttttttgagacaggctgttgttctgttgcacaggctggagtgcagtggtgcaatcatggctcattgtagcctcaacctcccagacattcacaacacttgagtacaccagaatagcaacaggtggcggccacaaaaattgttacactggtaaatacgtactatatttaattttacacagctatgatttaatactgtatctttacagctgtttacatttcttatgactgcaaatggtggaaccatgtggtttgagtgtgtatatgttttgataaattttaacttgttatcatagatttgtatatattttatggtagtaaatgatgaaatagactagtacctacatatattttatacattaatgacatacctttttcttaatttttttcactatttataggttatgcgatttttctgttttttcagtgttgcaaatctccaaacattttccgatatatttattttttaaaattcatgtataatgtcgccacccagttaaaacctatgttgttcaagggtcaactgtattattatagtcatcacgtttcacaattgatctttagaacttattctatccagctgaaactgtatcctctgaccaacaacctccaccccaccacacctaccccaccccctaatctacaatctagttctacgagatcaacttttttagattccacatataagtgagatcatgtggttatgtgcctttctgtgcctgccttattcacttagcctaatgtcctccaggttcatccacgttggcacaaacaagatttccttctttttgtggcagaataatattccattgtgtgtgtatatagatatatggagagactatgtatctatctatctatatatacatacactctagttgaagcaattctaaagttaagtcattgtccaaatatttatagacgtatttacaagttactatgccttactttacagcttttctaagtcatcaaacacacatttttatgaaactggaagaaactaataataataatttttaaaatagaaaatgatttcacaaactttaccaaaatgttcgaaagatatggtacttgttggaaaaatagttcttggcaacacagaagaaatgagaggaaggacttctgtttcaacattccagggtataaaaccaattctgaaaacataataaagacatttttgtttaaatggtttaaaaaattaaaccaccaatttaaaagtattaattctctaaatcaggttagcaatattaaaatacagtgcttaaatgttttttgcccaaatagctaaaaatgtaaattcaaggttactccttgtctaaagatagctaccaattggctaaaattcagaaaaaaacctttaaaagtatgtttttctgataaattcatggcaaagaaaagatgaaagcaacttaacacagatgtttctctttgaaataatttatgtagtattttgtcaagaatttttccagctttcatcatgttcttcactactctaaaaaaataaaatcaactttgaggtgtaattcaacataaaatgcagactttaagcgtacatttgctaactttttaccaaagtgtgtgcatatatatatatatatgtctgtgttaaccaccaccccaatcaagaaagagaacatttctgcccccctagaaagtgtcctcacactcctttgtatccttctccctcctttccaggcaaccaaggaactgatttataccactatgttatattctaaaattcctcgacctggtgatggctcttcaaagttctcagtgtccctagagacctgttaagaccccctccttcaaattttctccattcaaacccaaaccacttcttggctttctttttcttattcatttaggtctcctaacaaaagactatctgattcaatataaggtaagattctggagtaggagaagcatgggaaaaaaaatgtaacttgtacatgtataaaaatatgtaactataaggaagggtttcatagtacatacatctggaattcttcatctgacttctattatgttctgccatcattcttagagggtgaatgccctatacagaactatattatagtgacatataaaataaagtcataatatgttataggaattaatataaaactcaggcagcgaccctaatctttacttaggagcttgatttaagtatatattatttatctagcaccatcttagtagcttcaagaataaactaagaaataaaaaactagattacagaaagtcatgagtgtcagggtagagtaggcacttgatcaaatagttatttagaaaaacatttttgaggagaggaatatggtaaaagcgtgattcagcggacagcacgcaggtaagactggaatgggagaagagtagaggaatgatgacagatgtattactaacaataaatcttaatattcgggttctctcccttttaaataaatctagcatatacacagctatacttgttaaacagataaattaaggattctttactttctaaggggtcctttatatagcaatctttattgggcatttgaaacaccaaagtttaatttgcacaaaacttccttaggaaaataacaattgaataaggtacccttgtacttaagtactaatgctatcttgttcatgttagcatgtaaacacctgagtaaataattttttatttttaccttccaattccaggtaatgtatcaggaaaccatgacaattccagttcatgtctcttctgcctaatcaatgcactgatttcactggcttctataaattctgtactaaaagataaattttagaccttcatcagaatctcacaattttaggttcaaaaaaacaattaggttgtacaaagaatagcagtcgtttttgtacctggcattatgaatcacacttacaagcatgtgagctcttttctatttaaacactttcaaaataaactcattcctaaaataagtacaatttttatattgcaaatcagagttgtatttatatgattgttaaaaataacccttgaatttctatcttaagtgacagaattttttaaataaagtcaagtcagagtaatatcctcattattgaaaggaagaaattctaggtgcaatagtttcctacttgaaactaagcctaagacaaaagaagaaaataaagtagggtaagatgactgcaaccaaaaatgggtatagttcagcttttcaaaagcctacttagacataatttttttcttggtaccttgccaagttctaaaattaaatcacacaatcgtattctgtgctgctggctcaactaactgtacgtgattttaaaacctcaatttaatcttcaaattccataaatatcaacttagtatctacatgccagtcactaggattcaaagatgaatggatcagctgtaaaagggttcttctttaggtaacatccccacaagctaataaataagctacttctcaatcatataaacagcttatatagaacaacttattaatgaaaacaaagcacactggcataggcaatcactgcacaatagagaagctcccaaaattaacaggttttctctttgctagagctagtttaccttcccccccgcccaaaaaaaaactaaagcaaaacaaccaggtgggcctttcagtttttattgggcccagagtttaaatttctagcaaaagttaataattattaaacatcaagtataaacagcataaattaaaagtagaaaatactaaccaataagctctataggtaaaggaagattctccagagtggctaacagaagaaaacatattggagaaaaaatttctgaagcactgatttgtactccaatttgatctctgaggctagaaaagtaaaaagtagttagtgaaacagcaaataaataacaggtaaataatagttatacttaaatattttgatacacctgaagcactggttatttatggactaaataaccctaaagtgttatcatctaagaaaaagatttttcttggtttcaacaaaccttatttatctttattgctgcatttttctttcctcctgtttcactgtataaagagtttcctgtacaaagacataaaaggacttggttaccttgtattaatttttattaaaaaggctgtaaaccagcatcgataccagcacattggcaagggttgaaatacgtagaaaagctgtatttcaaataatacacaattttttacacaattttcccaaatgctgatttcatcttaccttgttaagctattactacaagtaaaatataaaaggccacaatacagaaactgggtgaagtatgtcaaacctgctatgtttacaacatatgagttaaaattctaatcaacattttctgctaccttatgcaaacttaaagtatcttgtaacaaaaggtatacacaagaagtcaagctatttaatatcaataatacacttaacatttcttttccagctatcatctagaaaacaggtagctatctcaagcaggggctgactaggtggcctggggccatcagctcttgttaaccataaattaccatttagccactggcacccacttcaggtatgttctttccttccaattttatactaagatggaaaagtagatgtgctgactgaaacagctttctgttacaacgttggtggctgcattgcttatgacttgtccacagtgcatatgacaactgccttttaattttcccccttgcttgcctcacaaagggcctattgacattgttcaaaataaatcacactaactaggaggcttgtttcctgcactgcaagatcatatgtattttggtttacttctgttagttcagttggtaatagcctactttctacttaatagcatactaatttcctttttagttattatacaacagctgtttggttttgcacaagtccctctcagaactactgtaacaaatgtaatttcaatgttagtggaagacgaacaggctgagttccggaacttactgccttacccctttgaaaatctgtatctaaaagatgatacgctgattttttaaaatggcttaagaggcaagaagtaaaaatgtgtggtaggtacacagataacactcttagaaataaccatgttccttcagctagacatagaattgctgtgctatacctacatagtgtcttttatgccctaaggatgctgagttgttttgtttcaggttgcattcactcaacacttaacgagtatgtagtgtttacatagcattctttcatttggaaacctatctcagaaagccatcattagataaaatgctctctactgaaagaactgttagttttctctgagcaatgctacatgtgaaaatccagttcaaaagctgtttcacatatttctgggtaattctcaggtaattactcaacagcttcaatggcaatctctaaagtattcgatactggtgaatttgtctaaattgtggtttcctgaagatcgtttcacaaatccaccctacttgtctgtttttggtgggcagtgatacgccttttcatttaatttttatcaaagtaatgcatgtacatactttaagatgtcaaacagtacttccaaacttataaagaaaaattatggaaatacccactcttgatttctgcttccccaaagcactcatcaaatcctttggctgtttcttctaacatttacttattactaaataacacccttatactactctatgtgtggttttttttgttttttttttttgaaacagaatctcgctttgttggccaggctggagtgcagtgccacaatctcggctgactgcaacctctgcctcccaggttcaagcaattctcctgtctcggcctcctgagcagctgggactacaggcgcacaccaccacgcccggctaattttggtatttttagtagagatggggtttcaccatattggtgaggctggtcttgaactcctgacctcaggtgatccacccacttcggcctcccaaagtgctgggatcacaggcatgagccaccacgcccagccagcttcattcaggtattttcctagggttaataatgtctttgttttctcttttccttttcttccttattatccatcattaatttagctaactacaacaaaagtataaatctgagtttaatacactcaaacacaacaactcatccataaggtttgttccccactctcctggcaaaactctttctttgtcctggtccaatatgaactggtaactctcaaagctgctgttcaatagtcattttgggattgtcctttgtcattatcccaataatcctctttgtcctgtttaatcttttcctgagttggaactcattttctgaatctcacattgttcttccatttactatctcatttagtgaagtatatacatacatcctccagcagaagtggaaaagggtgggaattctgagttagtgcacgatggatagtttgataggttatagaattgtctaggttagtaattattttccctagagttttcaaggcattgcttcactactccaactattgttgatgacactctgtaaccccaatcctctatgtggtctgtttttactctctctcttgtcatcctcagacttctagaactttatgaagtatttggtatgatttttttttcatttactaagtattatattatttcttcatatctggacacctgtgctctactattacggaaaaaatttcctttgtattacttttttaaaaataaatttttgcatttttccttcctgaaattttattattcgatattgaatctcttaaatgaatatcctatcatctcttttttagtcctactttgagacttaagaacttatcttctactcctgttgaatttttgtatttttgctgtaatatttttaacttctgaaagctttttcttaaatattatttttcttgtatcattgataaaatatcccttctttcaggctttgaggatattaagttttttaaagttattccctatttttcagcattgggtctgtcccatcaggttgcttttgtctttgttttgatctctattatgttgattttcctcaaacatctggagatccttgattgtttgctggacactaaaatattgattgaaaatggtgtagatgggtggtcagagcctttcagctaatgtgtttcactgtagggtgatcaagcagacatctggttacttcattgggagactctcaaatgacattatctttaagtcttttcttttgggcaagtcagttttccaaaagatgtcccttatttcctactttggaaaattataataatcaagactgccagtgctttgaaaaatgctcttaggtagaggactagaagcctcatcatttgacttaatttccctctctgttgtttcctgtaccatcatttatgctaaagtttaaatctggttcaaatactcattttagagtgtaaatctccagtctttcattgggtactccccttcctctacccacagccaggaatcttcaggatctaaagatttttaaccaattctgttttccaaaaccaccccatatctctgccttcacagataatggaggcctccaaactcaacttgctaaggtttgatggtatgtgtactgtcttgagattcttaactccattcttcccatgaaatgtctatgtatcagctttctgctaagacaatttaccatccccctcatactgttttactttctattttgtggacacttatgtgctgtccccctctctccagctttcttgtctttgtggcttaaactttgtggcttaaaactcttctttctggccaggcacagtggctcacaactgtaatcccagcactctgggaggccgaggttggcggatcacctgaggtcaggagttcgagaccagcctggccaacatggtgaaaccctgctctactaaaaataccaaaattagccgggcatgatggcgggcacctgtaatcccagctactcaggaggctaaggcagtagaatcacttgaacctgggaggcggaggttgcagtaagctgagattgtgtcactgtactccagcctgggtgacaagagcgagactgcatctcaaaaaaacaaacaaacaaacaaacaaaaaacacacttttctttcattcctttattgtcattttagtagagatttgggatgagagggatcacagcattaaacaagtactcaatctgctatgcttaactagaaccttgttttatttatgttaattcagcatatccctaaacatgtttcatgaaacactaatccgaaaggatgtttcatgaaaacatccttttgtacgatacaaacaagtataataaaggctctgagcttagaacccagtacttggcaggcatccaattaaagtctgactaattgattccaaagtttaataaagacataattagatggatctagtatgtacttaaagaagtactacattaagaaatgcctgaaagggagatcctgtctgtaaactatatcaattataaactactatcccaaaccaaagattaatgttcattccaagaaacaaagtgaacataaaggagattaaaaacaaaaatgtataattcagttatctagtatgacagaagaaagaaagtgatatttcctcaacaaatttgctaataggtttgctgtctaacctttcactatacctctagtgtggcaacatcatcttcattatatgagaaaactagacagtttatataattttactaaagtcacaggtgttttaatggtaaaaactgtacaaaactcaaggggcttgacttccagtaaaaccatctattagacctgctgaagttttaactaatagtatactatatttataggctataataatctctaatcaagatataagaattcgcaacttcacaaactctattcattagtttgattactgtataacaaatgacttcagatagaaagtcacacacctatgtttaaagaacagtcccatcctgcttcacaaaactttaagaaattaaagaagtttggccaggtgcagtggttcacgcctgtaatcccagcactttgggaggccgagacgggcagatcatctgaggtcaggagtttgagaccagcctgaccaacatggtgaaattcccctgtctctactaaaaatacaaaagtagctgggcatggtggcgcatgcctgtaatcccagctacttgggaggctgagacagaagaattgtttgaacccaggaggcggaggttgcagtgagccgagatcgtgccattgagatcgtgccattgcactctagcctgggcaacaagaccgaaactccatctcaaataaacaaataaataaataagaaaacaagaagctaagctaagtagagttgcttctaaaatctaaccaatcaatcctagataaagagacagacaacagtttctcaagtagttcttttataaaaagaaatttaaattatccttaggctatatcatggtttctgttcagtgtaactgggtaaataaagatgtattcaatttgcacaatcccccactaactctaccttcgtgactttgtctcttggttccttgct

SEQ ID NO: 475 - DNA, 38579 bp, Homo sapiens
ggtggaggttgcagtgagtcgagatcgtgccactgcactccagcctgggcgaccctgtctcaataaaaagagcaagagagtacggatccttcatagacagagtcgggcattcccaaaagtaagaggaggaatgtgtccaccctaggtacattagttgtttatatacaggataaaaaagatcatggagagatgtgctctgctacaagggtttttgataaaggattaattttcttaatcaacatattttgcaagaatcaatgttattatttttaaagcaaaattagaaatgcttctgttctcaaaacatcaggatgaggccaggcgtggtggctcacgcctgtaatcccagcactttgggaggctgaggcgggcagatcacaaggtcaggagatcgggaccatcctggttaacatgctgaaaccccatctctactaaaaatacaaaaattagctgggcgtggtggtgggtgcctgtagccccagctacttgggaggctgaggcagaagaatggcatgaacctgggaggcagagcttgcagtgagccaagatcccgccactgcactccagcctgggtgacagagtgagactctgtctcaaaaaaaaaaaaaaaaaaaatcaggatattaggacactcccacatctgggtctgtttagtaaacatctagaggctaggagtacctaagtttctggaaatgcagcccagcaagtcccagcctcattttcttcgccctcaccaaagatggagtcgctcaggttcgaacaccatgacagtttcagttactcgtggtcaactgtggtctgaaaataggtgagcatagtacaattaggtaatctgagagagagaccacatccacataacttttattacagcatatggttataattgttctattttactgttagttattgttgttaatcttttactgtgtctatttatatttatatttttatgtatttatttatttttgagacagtgtctcaccctgtcaccaggctggagtgcagtggcgcgatcttggcttactgcaacttctgcctcccaggttcaaacgattctcctgcctcagcctcctgagtagctgggattatcggtgcctgccaccacagctggctaattttgtatttttagtagagacgggtttctccacgttggtcaggctggtctcgaactcccaacctcaggtgatccgcccgcctaggcctcccaaagtgctgggattacgggactgagccaccgcgcccagcctactgtgcctaatttataaagtaagctttatcatagtctctatgtgtagggcaagcttgtctgacccacggcccatgggccatatgtggcccaggatgactttgaaagcaacctaacacaaattcataaactttcttaatacattaggagggacgggcgcggtggctcacacctgtaatcccagcactttgggaggccaaggcgggcagatcacttgaggtcaggagttcaagaccagcctggctaacatggtgaaaccccgtctctactaaaaatccaaaattagccgggtgtggtggtgcacgcctgtaatcccagatactcaggaggctgaggcaggagaattgcttgaacccgggaggcagaggttgaagtgagcagtgatcatgccattgcactccagcctgggcaacagagtgagactctgtgtccaaaaaaaaaaaaaaaaagaaattttttttaaagttcatcaattattgttagtgtattttatgtgtggcccaagacaattcttcttcttccaatgtggcccagggaagccaaaagactggacaccttggtgtagggaaaacatggtatatagagagtttggtactatctgtggtttcaggcaccaattggtggtggaggaggtcttagaaagtaaccctctgagggtaaggtgggactactatttctaagcatttgggatgggagggagaggctctgacaggtattcagcttgcagtcttggactggaaccatctcctacagtgctctctctaccataacttgccccatgtttgtgataggcaggaaaatggctcccctcccaaagatgcctatatccgaatctccagagcctgtgaatatgttatgttacgtggcaatggagaattacagatggaattaaggctgctaatcagctgaccttaaaatcattttctttctttctttcttttttttttcagacaaggtcttactctgtcgcccaggttggatgcaatggtgcagtcatggctcactttagccttgacctcccaggctcaagcaatccttccacctcagcctcccaagtagctgggactgtaggtgcataccaccatgcttggctaatttttgtagttttcatagagacggggtttccccatgttaaccaggccggtctcaaactcctgggctcaagtgatccacctgccttggcctcccaaagtgctgagattacagatctgagccactgcacctggcctgaccataaagtagggacattatcctggattatccaggtgggcccagtgtaatcacaagggtccttaaatgttgagaggggcaagagagttagtgtcagagtgatgtgatgtgagaaagactcaggcagccattgctggctttggagatggaagggggtcacaggcaagggaagacggcagcctcttgaagctggaaaagacaagaatacagattctctggccaggcatggtggctcacacctgtaatctcagcactttgaaagcctgagacaggaggatcacttcaggccaggagttcaacaccagcataggcagcatagcaagaagccatctctacaaaagatcaaaggataaaaaattagctgggcatggtggtgcacacctgtggtcctagctacttgggagcttgtttggaggttctagcaggggtgcacagtactcgtatacccttgaccaaagaccagtcctcctctatcggggacggtcatcttcttcaactgagcgcacagcttcaggagggacgcctatggagaggtgagggaggaaggagacacccgcctagccagccagattagccgaatcaaccttggtgatcaatggggtgacagaagttgcagtcatattacccttacatccagtcctagctgcttgggaggctgaggcaggaggatctgttgagactgggagattggggctgcagtgggccatgatcacactactgcactccagcctagccaacaaagcgagaccctgtcttaaaaaaaaaaaaaaaaaaaaagaatacaggctctcccctggcgagaaagaaggaacacagccctgctgacaccttaattttaacccagtgtgacccattttggacttctgaccttcagaaatgtaaagataataaattttgtcattttaagcaaccaaatttggggtaacctgttgcagcagcagaaggaagctgatacaatgtaacatgactggtggtgtctgctcttccaccacttggctagcttcttgagaacaagaacacctttgtctcctgtatttacctagaatccttttttttttttgagacagagtttcgctcttgtcacccaggctgcagtgtaatggcgtgatctcagctcactgcaacctccacctcctgggatgaagtgattctcctgcctcagcctcctgagtagctgggattacaggcgtgcaccaccatgtctggctaattttgtatttttagtagagatgggctttcatcatgttggccaggcggggctcgaactcctgacctcaggtgatctgcccttctcggcctcccaacaagtgctgggattacaggcatgagccaccacacctggcctattcacccagaatctaacacaggatctggcacacagtcagggctcagtaaatacctgttgaatgaacaaaagaccgaaatacagctccagctttgtggttctccagaggttttgagcgtccaaagcagcctctacgcttaccctagtcctggagaccctaagccatgtgatctcagttttctcgtttcctttcccccattggcccatgcttaacactgcaaggctggctgctattcttttgtttgtttgtttgttttgagacagagtctccctctgtcaccaggctggagtgcagtggcatgatctcagctcactgcaacatccgcctcccgggttcaagtgattctcccgcttcagcctcccaagtagctgggactacaggcgtgcaccaccatgcccagctaatttttgtatttttagtagagatggggtttcaccatgttggccaggatggtctcaatctcttgacctcgtgatctgcccgccttggcctcccaaagtgttgggattataggcgtgagccaccgcgctcggctgactgctattctatgtgcagtttcctcccttgctgtggatcattcccctcctctctctggccatgtgtgtagggagcactgagatggaagacacttgtcacatactataggtgattttgccaaccagccttctgcgggttatgcctgaaacagcaggttgtgttttccttcctgtctcggattctgtccgctttcctctcttctccatagccacctctatccatattttctatcaggtttctgtcctttgaagaccaattcttttcttttttttttttttttttttttttttttttacttatttacaatattcttcgggtcttcatctctccatttcctgtgtcctgaatgaagcgcatagttctggtctttcttatagcccttcttaacccccttctcaaatggttccatggctttccgggatagacaatgaaaataattaaagacactctcatataacgtcgggtttactgcagagctcctcatggaagcactcagtttattttatgcagaatggtcaactcctctcataaggggagagtggagcggctgctgggtcactggaatattgttattctgttgctttcttttcagtcagtcattctcaggccccagcttctctgatttctcggtgagcttagtttctgcctccccagctttccctctgtgtgcctcaaattaaatctcttccggaaccaggctctgatgagcgtgcctggtcatggtctaactcggagttctcatgccagacctcctccagtgtggctgatgtgtcctgtatgtttttgactttggtaactgagttaattcctgggccagtcttttgtggccaagtctagtagcagagccaaggttacttatagaaagaactacctccggccactcatcctggggctgtggctactaggcatacggattcctctctggtacaaactctttttaccaaaactatatttggaggtaatcataccttttcattctcttccatccttccccctttcctactacacaaagatagcaagttttttcaccttgttgcccaggctggagtgcagtggtgtgatcacaactcactgcaaccttgaactcctgggctcaagcaatcctctcgcctcagcctcctgaatagctgggactacatacacccaccaccatgcccagctaaagatagcaagatgatgaaacaaatagatcatccaatttcaccccccttcacccccaacccaagtgtaacattttcattttggtggaatccgtaggtctcagttatctgatcttctgttgggggctgcagcatcagaacagggaggtctagacccaggacaatggcttgtatcctaaaggtgaaatatgacttctgttcccctgtaggcaaggatcctgggtctcgcatggttcaaggtatcagaaataagcaggatctgagatctatattatgcggctggcagtcattcttcattcttgtatgaagatactctcttctcccttcttttttccttttctttcttttttttttgagatggagtctcagtctgtctcccaggctggagtgcagtagtgtgatctcagctcaccgcaacctccgcctcctgggttcaagcgattctcctgcctcagcctcctgaatagctgggactacagatgcacactaccacgcctggctaatttttgtagagacaggattttgccatgttggccaggctggtcttgagctcctgacctcaagtgatccacctgccttggcctctcaaagtgctgggattagagtcatgagccatcacgcccggccttctcccttcttttcatccccgaaacctaagctagtaaccagcacacctttccttaccctcttttatcatcagcactttgcacagcctactccaggaaactcggggtggtagggaagctaccagcagcagctctctctccacacaataacatgggcgtggagccccaggcagatgagtagtgcctccctagtaccagagtgctaggaattctttgtcatgtgcagctggtgttggtgcttagaagaaccaactggacatttctgattttaggtggagtaccagtcctggagactaaaacttagaagagtgtttgcaagttaacagagtgatatcatagcatgtcttcgagaaacacagactcattgatgatagtatgaaattatgtaatagcagcccatacatgttatgctactttacagcaacatgaatttttgaaatggcattgcatactttttttttttttgagatggtgtcttgctctgtcacccaggctggagtgcagtggtgcgatctcggctcactgcaagctccgcctcctgggttcacgccattctcctgtctcagcctcccgagtagctgggactacaggcacccaccaccacgcccggctaaatttttgtatttttagtagagacggggtttcaccgtgttagccaggattgtcttgatctccttacctcgtgatctgcccgcctcggccttccaaagtgctgggattacaggcgtgagccaccgtgccaggctgcacaccattttaataaagagaattttttttttttttttttttttgagaaggagttttgcttttgctgcccaggctggagtgcaatggcgccatctcagctcactgcaacctctgcctccctggttcaagtgattctcctgcttcagcctccagagtagctgggattacaggtgcctgcgaccacgcctggctaatttttgtacttttagtagagacagggtttcaccatgttggccaggctgatctcgaactcctaacctcaagtgattcacttgccttggcctcccaaagtgctgggattttgggtgtgagccactgtgcctggctgggtcatttttaatgtcctaaagttctcttgttctcttcacatagatctggcatatttctcaaaatattataagcatgtgtgtatttgtatttatatctataatttattgattttttggctgctatgatgaatgggaatttttttcccttttagatttgctaatctagacttcattttgtaaaggttttgtcttagttgaagttcttatggtagcaatttacagaaatacattcagattaacttaggccaaaaaaaaaaaaaaaaaaaagcgggggagaattctctggaaggcagccaaggcctcccctacaggccaagggtagaaaggagagtgggcctcacaagggggagggaaacaagaactacggagtctcctgttgctttcccttagtagatctatttttctctccctctgtagttcagctttctttgcttctccctttgtccacttccatgtttctgagaagcaaagggatatagagcaaacctggctacaggggctacccatgtgggtggagcaattctcagaaaataactatgggttgaaaaggcacggctgaaacagatttcaagacactgcaatgtcagtgacttgaaaagaatctgtttcttgcctaagaggggtagagttggcagttactgtttgggagaatctgcccttctaagttccagatgattaataaacagggactgacaatcgtcaggttatgggattaataattcaacaaaatatactgagctcttactctgactttatatttgcatactagttagctgttgtaggggctgaaaagttgtgatgcctttcttcctcatcataagggtcagagctcgtataacaagataggttaagagaaaaatctaaaataaactaagaagtttatttaatcaaagttttacatgacatgggagccttcagaaatggctacccaaagagccagggaaaacttgtttttaatgcttagattctatgaaaaatggacagcctgcagtaatgtggttgggcaaaaagtgtgccacttaatagtaacagacagcaggtggaaacccaacgaggtctttctgtgtagcattccttcctcccaggtatgaggcaggatctcttccagaatgagggtcttacggcctatcagacaaggtaggccagagaagttctttacggccagcttgttttttggactgagtttccctcctgttgcccaggctggagtgcaatggcgtgatctcggctcacagcaacctctgtctcccgggttcaagcgattctcctgcctcagcctcccgaatagctgggattacaggcatgcactaccatgcccggctaattttgtatttttagaagacacagggtttctccatgttggttgggctggtctcgaactcccgacctctggtgatctgctggcctcggcctcccaaagtgctgggattacaggcgtgagccaccgcgccaggccacggccagctcttacatagaaaggtggggggaagtttaggttttatggctggctttgggggagagggcttctagtttctgtgactcatcttggggaagaggaattctggtttctatggcttgccttggggaagaaagaaggctgggagacaggagggcaggaaaaggtcggagagactgtgcctgaggccttccagtctcttttagttcaaaatagtcagcataccaaagcgccgtattttggggtattgtttttctgagctcaacactgctgcttcggatgtatctccacttactttatttaacctaaaaggctttcagctcagagcacaagtagtatgccatgaatgcgaaattgtgtggttcaaatattcaaaatatttgaaatatttgccatttcaaatattttgtcttgagaaaataaaatctttcaaatctggcaacttgggataaagatgactatgatcctatccctcctttcaactggcttaggattcattttgattttcctctgtagaaatggggcgcttcatgaaagaaactctctctgaaaaccaggaattctgttaaaagacctttttgctaatctagttcagtagttgacgttagcatttgacggggagcctggtgaaagctaccatgagaattcggaagcaagaaactggcagtcctggcgctactggttactaattgaacgaccttcgcaagtaacctagcctctgtgaacctgttctcattttcaaacgcggttgaataactacttttcaactaggatgttatgaaaggtaatagggtaaagacaaaggactaggttcgcgtggagcccagtactgctgaaggaaagatacacgagtttggagggagtctaaggaaaaggaggcaaaggaccccggaggttatatcctcggtggcctcagcttttacacgatctaagtccatcctacggcggatacgctctcctttcactggaaaatgactgtttgcgttgaaaaaatttttatctaacaaagctccatttctctaaactttgcttccccgcccagtttgcaaacgagtcagggtttcctcaccggcgcggtaggctcgccgaaagccaagcgggagccccaggctgcgcagggcgggggaataatgggtgcccagctccgggccaggaagcccagggaaccactgcagccaccaccgcggtcaggagacagcccccgcaccgccccttttcgattcgtttgcatgatctacggcgcggtttccggcggcagagacatgttttccggtcgtcccttggctcgattttcttccggggcgggacttcctttccatcattgataggcgccgggcagctgagctggtaggaggaccagacggggaggttcggtatgtctgaccaggacttatgttcctcgaaagggcggccaggaggatgctcttcctctcttttctttctcgcctttttctccgcatgacgcctcggtttgcgcggacgccctgggcttttggcactaccgcccacctgaggctcttccgcttcctctttccccccccaggctccgccccccagcgtcccgtggccatgacgaccgctcagagggactccctgttgtggaagctcgcggggttgctgcgggagtccggtgagtggacttccggttgggctgggcctcggacctcggacgaggtgggggtggtgctttctggagacacgccctgagagtcatggagttacgactggtagggtcaccaggtgtcagagttcaatttctttacttttcccaggtttgttcgcccttacagtgtcctttgcctgtgatagcctaaactctagccgtcctttgaggccaaagggcggtatccctccctccgtgccttctctgacactgtcagaaggaagtgatcattacctgactaaaagcccctcaggaccagggactgatctcggtcataatcattattgtgtagcaaggtactaaatacagtagatagaagcacgagatttggagtcggacccacttgggttggaatatcaaccctctttcaaacttgccatactgtttcctgaggctcagttttcctcacagattggcatagtgattgtacttaacatttgtggggattcgttttaattcatgtatttagtacaatgcctgcaagtatagtaactgcttacagttgggagctattgttattgtaatgatttccctgatgcttggcactgtgcctgggcataatggagccacagtagttgttgaatacttggttggcattagttgtggtagaaaaagccttggctttgagatcagataggagaagtaacttcctaccaattatatgatctccatcaagatttttcacttttttgaacctcaattttcatatctgtaagatggggttaatagtgcttctctttgagagattctgagaaggtttgaatgagataccaaagtcatctggtacatactacagttaatgttagctgtcctccatcactccatgctcctattgacgatatctgtggaagctctctttatagcagttttcttttctttcttttcttttttttgagacagagtcttgctgtgtcacccaggctggagtgcagtggcgcaatctcagctcactgcaacctccacctcctgggacgaagtgattctcctgcctcagcctcctgagtagctgggactacaggtgtgcaccaccatgaccggctaatttttgtatttttagtagagacggggtttcaccatgttggccaggttggtcttgaactcctgacctcaagtgattaacctgccttggcctcccaaagtgctaggattaaagtcgtgagccacagcacctggccagtagcagtttcatttcctggcttgtattgataactttgcaaatgtcttatatccttctctgggaggagacaactaggaggccctttgaacgtgggaagagtccttgaaccatgtctgtatctatcctcagtgtctagtacatacagaatccttcatgtcaggttgtaggacttgttaatttattcagtgatgaatggtgggtgtgtgaatgtgtgactacaaggaggtagcaggagaagagctttgtggcagcagaatagttttgtatcttgattgcgtggctgcaggaatttatataaacagcatatagctatatatacatattgtaccaacatcagtgtcctgaatttttttttttttttgagatggagtctcgctctgtcacccaggctggagtgcagtggtatgatctcggctcactgcaacccctgcctccctcccaggttgaagtgattcttctgcctcagcctcccgagtagctgggactacaggcatgcaccaccatgccctactaatttttgtatttttagtagagacggggtttcaccatattggccaggctggtctttaactccggacctcgtgatccacccgccttggcctcccaaagtgctgggattacaggcgtgagccaccacgcctgccctttgtgtttttttttttgtttttgtttttttttttttttttttttgagatggagtctacctctgtcacccaggctggagtgcaatggctcaatttcggctcactgcaacctctgcctcctggcttccagctgttctctggcctcagcccctcgagtagctgggattacaggcgcatgtcgcaatgcccagctgagaatatttgtatttttagtagagacgaggttagagtcgtagaataattttttgtgtttttagtggagacggggtttcaccatgttggccaggttggtcctgaactcctgacctcaagtgccttgctcccaaagtgctgggattacaggcctgagccacggcaaccagctcagtgtcctgactttgatattgtactatagctatataaaatgtaaccattagggaaaactgggtaaaggatacaggggacctttctgtattatttctgcagcattctttgactccatacttattatattttttaagccaaaaaagcattccttcatgcctagcttgtagctgcacttttttaggtgcagtgatgaataccagagtgatcaaaagatgccctcaaggatgaaagtctcattagagagagcagttttaacagacagcaataacaatgccttagtgctataatgaatagttattctatgacatactttttagtattgtttgaaagtttctacagatgtgctttgcaatcagaaaaagaaagaaagataaaacttccaattaacttttgtgtaataatgagtgactgcaatatgaaaattcagcagtattacttcttgaggcggcttcctggaggaggctggtctcaagctgggcggtggaagggggtgtctcataacaagagagaactgtgaaccaagctggctgtatttccagcactgtcagtagatgaggctcttttgagcagaaggtgaaagaaaatttggaagagttggttggagttgtgtagccaagcagtctcatcaggctgaatgaaatgttaggactttttttgaagatgaggggagccattgaatgcttttgagctgagaaggagatagaaaatttgatcctgcaatagaagatctacaatatggattggagtgggtatattttggcatcatagagccttagaataaagagaaaaatcttttcactgtgtcttccctcctgtttgcccctttttctgcaggggatgtggtcctgtctggctgtagcaccctgagcctgctgactcccacactgcaacagctgaaccacgtatttgagctgcacctggggccatggggccctggccagacaggctttgtggctctgccctcccatcctgccgactcccctgttattcttcagcttcagtttctcttcgatgtgctgcagaaaacactttcactcaaggttctgggtgtggggaagaggcaggatgtgcaaggagcccaagagaatgatggaagttggggatagggtaggggtgcagaagtctgcagtgccaggatccagagggtgtcagaggtaccagtggttgtgctaaggaaggaatgttgagggcaggaagatctgctgtgcctcagtaaattgagtttttttttttttttcagctggtccatgttgctggtcctggccccacagggcccatcaagattttccccttcaaatcccttcggcacctggaggtatggggacacggggggatgttggtgcacagcacccaacttgaggcagccccttggggatgggaaagagaagagcctctttggtgaggaggccaggcctgagtatacccattgctctgcagtcatgtgatatccactgtctttccatttactgcttccctaaatcatagctgggctttgtggtcttctccctcctcccaactaggggatggggatgaggtctttgtcttctgtggggttctgccttcctccctcctctttccttgtcccagctccgaggtgttcccctccactgtctgcatggcctccgaggcatctactcccagctggagaccctgatttgcagcaggagcctccaggcattagaggtaaggagagtgaggggtgagctcagacacctcaacttgagagatgtagaagaccaagctctgatgttctcccctctctgcagctctccctgcctcctgcttccctctagacagtgtcctcactccctctctgtgttcccgcagcactctgtaactgcctgtatatttatagtcgtacctaccatattatattacatattctagtgtctaccttcccactgtccctacagtgagttcttgggtcagggacctgggctttaagcctgtatcttcagatggagttcagtgtataaaaaatgaatgagtgactgggtggtagagcttggccttggcatagggaggaaggggagggtggggtaatgaagcacccatctgtctgctcaggagctcctctcagcctgcggcggcgacttctgctctgccctcccttggctggctctgctttctgccaacttcagctacaatgcactgaccgccttagacagctccctggtgagtgcctcagagggaagagggtttcgaggaagggcaaggccaggcctttggggaggagggccagctggttgaccagatagtattgtagtgaacatcgattctctgcctcctccccgtctctctcagcgcctcttgtcagctctgcgtttcttgaacctaagccacaatcaagtccaggactgtcagggattcctgatggtgagtatgggcagtttggcagctggcacaccatgggtctttgattgctctgctctcactctctctccttgaccagcttttactcccaccttgctcttgccatgagggtggagctgcattctgggagatagcactgcttagacactagcatcagacaaaccagagttcatatctcaacttctaatacctgtgcaactttgagcaagttagttacctcttggtttctttacctgtaaagtagaaatcacaagagtacctggtttttttttttttttttttttttgagatggagtctcgctctgtcacccaggctggagtgcagtggcgcaatctcagctcactgcaacctctgcctcccaggttcaagcaattctcctgcttcagcctcccaagtagctgggattacaggcacgtgtcaacacacctggctaatttttgtatttttagtagagatggggtttcaccatgttggtcaggctggtcttgaactgctgacctcaagcaattcacctgccttggcctcccaaaatgctgggattacaggcatgagccaccacgcccggctgaatacctgcttttatagtattaaaatgattgtgaagaagtacccaatgttgcttagtctagtgcctagctcagaaactggtagcttttgtgattatgatgaagaacctttcttctgggtcctcccatccacctgtcagagataaagccgaactagttaaagtggtaaggacagattttttttttctttttttttttgaggcagagtcttgctctgtcacccaggctagagtgcagtggtgtgatcttggctcactgcaaactcaacctcctgggttcaagcagttctcctgcctcagtctcccgagtagctgggattacaggtgcccgccaccatgcccagctaatttttgtattttttagtagagatggggtttcaccatcttagccaggctggtcttgaactcctgacctcatgatccgcccacctcagcctcccaaaatgctgggattacaggtgtgagccaccgtgcccgaccaagtaaggacagattttttatcagtgataaactattgcagcggggaagagggtgcaacctgaactgaacgccacttcaatttgtgcagaggtggctgggcattttaaaaggagagtgagggaataggaaggggaactgtgagggcttgagcagagtaagggaagtggaaatgtacgaaaagcagaagtggaggttgattcacatgaagcccttctgggtttgctaaaagttaggctcctaccttcccacagagactgggagatgggagccctgtcatcaggtgttggctagaacaaatgggaaattcttttggcagccttgacttttcccaggcaggagcttaagggggctagagtcaccattctagggatgcatccttgagatattagaactttgctgtttttgttcaggttttttactgtgggggttggaggagtcaacaaaaataatttgtgttgaattttgttgaacttgtgctgaacaagtctgcagttcttaacaggccaaagttgaggcctagtcaaaaagaaggcccagaggagcctgagtagggtttgatcaaggtgagaacctcctctaattcagggaaagaagagacactcctctttcccctgaacaatataaatccttttcttccttgatcaccttttgttcactaaaaaccaactgagccatttattgggacttggtagtggatgaattttgctggatggtgagagtgaccaggcatttaatgggggacatttctatggaaacaaaaagggaaacaaagatgaatggttggagcagactataaatccattttctgagtccagagggcagccagttgagatttctaggtgttgagctctatgtttctttagatggtggaatgaggatagcagtggcaaccgatggatttcttcgtttgtagtttgaatgtttgtggtgatagcatagacagtgttgcagtcacggttatttccctgaacagagcctggaagatacagaagtgtcagtggacttttttcctttttttttttttaatgagacagagtttcgctcttgttgcccaggctggagtgcaatggcacgatcttggctcaccgtaacctctgcctcccgggttcaagcgattctcctgcctcagcctcccaagtagctgggattacaagtgtgtgccaccacgcccagctaatttttgtatttttagtagagacggggtttcacaatgttggccaggtgagtctcgaactcctggcctcaagtgatcccccctctttggcctcccagagtgctgggattacaggcatgagccactgcacctggccggctgggcattttaaaagagggcggcggggagtgggcaggggaatggtagggccttgagcagagctgggggagtggaaatcaggttggtccacatgaaacccatctgagtttgctaactaactggcacttaccaaaataaggcccttaccctttcacagagactgggagacggggccctatcttcaggagttggctgaaacaaatgggaaattcttttggcagctttgacttttcccaggcaggaatttaaggggcttggagttgccatgctcagggtgtggccttgaactgttaggaacagtgctggtgttgttcaagtcttttaacgtgggagtaggggtggatgaaatcatttgtgctgagtgtgtgcagttttatataggccaaggttgaggcctagtccagaagaggtctcagaggaccctggctagagtttggtcaacgagataatctttttctcccctgtacccctgccaggatttgtgtgagctccaccatctggacatctcctataatcgcctgcatttggtgccaagaatgggaccctcaggggctgctctgggggtcctgatactgcgaggcaatgagcttcggagcctgcatggtgagtgggggtgtgtgatggggcaagcatggaggggaagggggagagtgaggctggggctggcctggggaccatgtgcctctagagccttgagagggcttatggggagtgcaggggtgctctggccggtctttctgctgcaacctcccccagtgcatgcaccacactcacttgcgtgtactcatccacatgctcttccttccttcttgcgtccaccccaggcctagagcagctgaggaatctgcggcacctggatttggcatacaacctgctggaaggacaccgggagctgtcaccactgtggctgctggctgagctccgcaaggtgagatgggaatgcatcaggggcctgggaaccacccttgcacgtacccccccatgctggtttggtcagtgccttcttcacacagggagggccagggccccaggccctcctcattctccccttcctgcccctcagctctacctggaggggaaccctctttggttccaccctgagcaccgagcagccactgcccagtacttgtcaccccgggccagggatgctgctactggcgtgagtgatcgtcctgtgtccactcttcttcccctttcctgcccagtcctcccccaccttgcaccctcttgccatccctgggtgaggggccaaggacctggaccctgcttactgtgttcttaatacctggagctcagcaggatgggcctaccacatactccctccccctttttgtctttgctcagttccttctcgatggcaaggtcttgtcactgacagattttcaggtcggtgtggttggggggcgaggactgttgggggaagacacgaagggagggcgctggggagagaacagagggctggctggtgacagggtcttcctggtcagtggaaagtagggtcccgccttttggctggcttgggcaaggcagaggtgctcccaggctccaacctctctctccttcctgtcgtcacgtgccagactcacacatccttggggctcagccccatgggcccacctttgccctggccagtggggagtactcctgaaacctcaggtggccctgacctgagtgacagcctctcctcagggggtgttgtgacccagcccctgcttcataaggttaaggtaagcagcgtcctccgctgccttgtgcctgcggttgggtgtctctccggggactctgggctacagtgggcagggaatggtaggaactgtgcttgcacgtggtcaaggtttctttgataggttggatggccagccgtggatggcagggctggaggcttggctttcacagaacttcttccctccaccaacctcagagccgagtccgtgtgaggcgggcaagcatctctgaacccagtgatacggacccggagccccgaactctgaacccctctccggctggtaagtcagcttcatcccactaacctctctcgtccccagcgagctcactctaatttttaagttacagtgaagatctgctggaagaaatgttattttttgttggggtagagtattatagagggcttcttagtcttttttcttttcttttagtttagggaaaggagaagactgcttctgggagcattttgaaaacttttcgaggaacattaattttgtggggtgtcaagagatcatgtaggccaggtgcagtggcttacatctgtaatcccagcactttgggaggctgaggtgggaggattgcctgagcccaggagtttgagaccagcctgggcaacatagagagatgtccatttctacaaaaaaatttttaaattagcctgacgtggtggtgtgcgcctgtagtcctagctacttgggaggctgaggcaggaggatcgccagagcctgatagttcaaggttgcagtgagctatgatcatgccactgcactctaacctggtgacagagtaagaccttatctcttaaaaaaaaaagtaaaaaaccccaaaacaaaagaaagtgtatatgtatatatataaaataataggattgtggccagagaagtttgagaaatgtgaggttgaagagaaataggtgtgtcagctgccggccgtctcgggcccttcaggatgctatcatgtatgctgagtctctggaagtagcataggatgcgcagcttggattgcatgtgaccacagggttccataggacacgctttagtacatgccgcggaggggacgcctgtagcctcccttgcccgtgtccccatacacagcccatcgccccctcatcgctgaggagcaccgttgaaggatttggggccatctgtgtggggcaggcttgctcagttctgggttcccctcctgcctaggatggttcgtgcagcagcacccggagctggagctcatgagcagcttccgggaacggttcggccgcaactggctgcagtacaggagtcacctggagccctccggaaaccctctgccggccacccccactacttctgcacccagtgcacctccagccagctcccagggccccgacactgcacccagaccttcacccccgcaggaggaagccagaggcccccaggagtcaccacagaaaatgtcagaggaggtcagggcggagccacaggaggaggaagaggagaaggaggggaaggaggagaaggaggagggggagatggtggaacagggagaagaggaggcaggagaggaggaagaagaggagcaggaccagaaggaagtggaaggtgagccctttgtgggctggggcgagctgaggccaggggcccttgggatgtttgtgagtggtggggcctggcgggtggagggccagttcgggggagggcagagtgtgggtactttccctccctgcaggccttttctcttggtctctccacagcggaactctgtcgccccttgttggtgtgtcccctggaggggcctgagggcgtacggggcagggaatgctttctcagggtcacttctgcccacctgtttgaggtggaactccaagcagctcgcaccttggagcgactggagctccagagtctggaggcagctgagatagagccggaggcccaggcccagaggtcgcccaggcccacggtgagtggggcgtggcagggtctctggaggagccagttatgggaacatggctgttgtgtgccctgcactgggctgggcatttctttcagtctctccttggcactaggagccgaggaggggagcctcagaggttgcaagcactcgggaagctgggctgaggagcagggattctgtgctggagcttggacgtcagtacaggcctttgacaggcttcagaggtcctgccatcctccatgctctcagcatcccctcatccctctgatcaccgcccctgctgtttttcacccggtccccctcttgctgcgcagggctcagatctgctccctggagcccccatcctcagtctgcgcttctcctacatctgccctgaccggcagttgcgtcgctatttggtgctggagcctgatgcccacgcagctgtccaggtgatggcgcccagagtgggggcccaggaggctgtggggattaagagagccagagggaagtggcagcaggcctgagggccgggggcctgtgggaggtgtccgtctggggtccgcctgctcacagctgcctctgatccaccctctgtcaggagctgcttgccgtgttgaccccagtcaccaatgtggctcgggaacagcttggggaggccagggacctcctgctgggtagattccagtgtctacgctgtggccatgagttcaagccagaggagcccaggatgggattagacagtgaggaaggctggaggcctctgttccaaaagacaggtacaagtcctgcccttgacctctctgcccacacgcctcccctgttccagggaaagtggctctgtgtaggggagtgtgaagggggagccctagggagaaggggctagagtggagagcagttgttctgcctggaggaaaaagaaaaccgtctgcctgctgcatttacaaaaaggaaaacagaaaaaaagaagaaactatatcctgttttttttttttttttaactctaaaagtcaggaaatgcaatctctgtaactgtgcttaaacatactcattattttttcataacttgaaggcttgttgtgttggggattttttggctgatatttcagacactacataaaacctaatgagccctcactgcagtattggattgtggtgctgcctctgccagcaagtgtagctgttgagtgagatgcttggggagttggcttggtttatccttcccggctgaccttggaaggtacataatgtcctgtggcatttcttcatgcgctagtccttaaaacaagaattgtttccattgtagaccagtcagcactatctttgaagaagacattgaagaagaaataaatattcttgataacagctctgtggaaatgccagaattttattagacggttttctcttcttggcggcagctggagcaggggtttagattttattcagaaaatggagccctgctccattccccactgtgaactggcctgggcatgcagccttagtgacacagcgcaaacagaaacagcccccagcccctcccggaccctggctgtacaccatgaggtgctgtggtctctggagcctcttccatggtggcgttattaatgaacattactgtgggctctgttctcctttaatttttttttttcttttttttttgagacggagtctcgctctgttgcccaggctggagtgcagtggcacaaccttggctcactgcaagctctgccttccgggttcacgccattctcctgcctcagcctcgcaagtagctgggactacaggcgcccaccaccacacccagctaattttttgtatttttagtagagatggggtttcaccgtgttagccaggatggtctgtctcctgacctcggatctgcccaccttggcctcccaaagtgctgggattacaggcgtgagccaccacgcccggccaaccattctcctttcacttgcacctcagttacctcctctgaacaaagaagggaatgaactcaccccatggtgctgttacgctatttaaatgtgacagtaaggcaccaagcagagggcctggcacaacacaaaggtctcctgtaaatggtagctgctgccgttgtccccagctgtatggtcctgggcagcatgtgtaaatgatttaatattttctttcttctttgcaaaatgggatagggagagtttctctggtgatgaaatgcgatcatagtggcataggaggtagcgcatgcccatcacggtgtagctgctcagagtgctgcctctctcattgctgatccatgtcctgattccttcccagcttcctgacactaaggatgagtataagatagatgctattgtcatccctgttttatagacgaggaaccaggctcacagagcttagatgacttgcccatgattacagagccattaattgatggagcctggaattggaccgaaatttggcaacagagttctctgcctttccagacctgttgattttggtctttcagacgttgctaggagagccctgaagtacttgatcagcccaagtctgtaagagggcataagagcaggtcctggttgtgtttggcccagtctgagagggcctagagttagaaggtagagtgcactttgaggagtttgtgggccagggttagctcatccctccctggggtggggagtgatcagttggcagctgtgccgggagagggagctggtggcctggggcgcggtggttgtgtatgaagctggaggcttgggctcaggggagacctgagcatggggaaggagcatcgtgagcatggtgggagttgtggcactgtggggggggctcatggggaccgtgtccatcctccctccagaatctcctgctgtgtgtcctaactgtggtagtgaccacgtggttctcctcgctgtgtctcggggaacccccaacagggagcggaaacagggagagcagtctctggctccttctccgtctgccagccctgtctgccaccctcctggccatggtgaccaccttgacagggccaagaacagcccacctcaggcaccgagcacccgtgaccatggtagttggagcctcagtccccgtgagtataggcaaaacaagacatagatgagtttggggaagggaaggggcactgatggggaggtggagatggagcccaggggctgccatgggcaggctgatgccccctcattgccctcagcccctgagcgctgtggcctccgctctgtggaccaccgactccggctcttcctggatgttgaggtgttcagcgatgcccaggaggagttccagtgctgcctcaaggtctgtgctccctgacactgcccatgcccccagctgtccagggtgcccactcgtttccatcacagccaactgagtcagatcaagcactctagagacctgatctggcttctggtttcaaccccagcagcttcttgctgtgtggccgtggacacattccctggtatttgagtcccagttgttgcctgtctgcaatggagataacgatgcctcccttacacagtggcgtgcgtcagggctcatgttgaagctgcccagcccagcacctggcactcatcaatggggcctcctagcattattataaacacatgatgtcgttaggcctttgttgagcacctgttgtgctagacattgaggatctacagatcaatcttgcccttgatcttacagtctggtgtgagaagctgacaatgattatgcaatatgcaaatgctgtaatcgggctaaggcccttgaaggggtgtctagtccagcttgagtgggtcaaggaaccttcctgggaggtgatgtctaagctcagtcttgaagggtaagttaaggagtagggaggaaaagaatgtcttaggtaaaggaagccgcaaatgcatggaggcccgagagtgtcgctggtggggagaactgcccaggatgagggcacctggacatgcagggcgaggggcaggggtcctgagaggactctggggggccggcaggggccaggtcaggagctgcctcctgtgtctgccaaggagtttggacttgtttctgagggccactgggagccactgaaggatttgaaatggggcagtgatggtcagttttgtgccttagaatagttagtctggcggagcgtggagggggtgaggcgacaggcagggaagccagctgctgaggctctgagcgggcaggggctgcaaggcagagagcggtggtggatgaagaggctgtcgagtgtgagggaagctccatagactggtgggtgggcagtgggagggtcaggccgagggtgctgtcaccaggaactcggctttcagtctggccccacctccccaggcctctcatcaggtttctcaccaacttcctcttcccccaggtgccagtggcattggcaggccacactggggagttcatgtgccttgtggttgtgtctgaccgcaggctgtacctgttgaaggtgactggggagatgcggtgagtgagaggggagatgcagtgagtaaggggggagatggggtgagttggggggagatgggggagtgagggggaagatggggtgaggggggagatggggtgagtgaggggggagatggggtgttaaggggggagatggggtgagtgaggggggagatggggtgagagaagggggagattgggtgagtgagggggaggtggggtgagtgaggggggaggtggggtgagtgggggggaggtggggtgagtgggggggacgtggggtgagtgaagggggagatggggtgagtggggggcggagatggggtgagtggggggcggagatggggtgagtgaggggggagatggggtgagtgagggggagatggggtgagtgagggaggagatggaatgagggggaagatggggtgtggtgagcgcacgggggtgatgcagtgagtgaggcaggtgcagctggggcagggcctctctgggactctcactccactctcatgcttctccattgctctgtcccctctctccacagtgagcctccagctagctggctgcagctgaccctggctgttcccctgcaggatctgagtggcatagagctgggcctggcaggccagagcctgcggctagagtgggcagctggggcgggccgctgtgtgctgctgccccgagatgccaggcattgccgggccttcctagaggagctccttggtgagagaggggaggggaaggcaggagggtgggcaggagggtgggcagggccttggggccaggctccccacctggtacccagtagcggagacagagaggtaacaggacttgtcccttgtagaagtttctgaaatccagaaatgtggagaataggaagggattgagaggtggtgagtttaggctggaggagagcagagccttctaaagttccctggcctgcctctgtctagatgtcttgcagtctctgccccctgcctggaggaactgtgtcagtgccacagaggaggaggtcaccccccagcaccggctctggtgagtcgataggaggcagaggctggggttgctgcccaatcctctttccacagagccccagacatggccctgtgctgagtaggtcctgggcagccacctgtcctcatgccatgccccttatgggcccctagtgtctcctcccaaccccctgcagggctttcttcccactcccctctcttcaagtccttcccacccgctagctgatcttcctgtgcctgccatattccctctaggccattgctggaaaaagactcatccttggaggctcgccagttcttctaccttcgggcgttcctggttgaaggtgaagcctctgtgcagctgatgcttccctggtctctgtaccctaccttgtcacaggcactggcccacgcgcagcacctgtacagtgcccttgcagcaactgtcagttcctggaacctggagaacctctcacttgagggcatagctgagtaacagcctcagtgtgccctgaccctctgggtggggttaggaggcacccaggatcctcagttacccagagcctttgctctcgggcccaggctttctatgaagtggagcagcgtggctgagtcggccctgcctcatcagtcacagaaggagagggtggagccttgtttctgagtagggtgggtgtggggcagtggggggcggtaggcctcagaggtattccagagtagagattcatggagcttgggaaagggagggtcttggccccaggggcacaggctgctttgtgacccacctcagagtgtggttcacacctcttctccccagcagcactgggacgctggccccagggatctgggcccctccatgaccttccacactggatgcctctttccctgcaggcccttccacctgcctcgtatccctgttgctgactccgtccaccctgttcctgttagatgaggatgctgcagggtccccggcagagccctctcctccagcagcatctggcgaagcctctgagaaggtgcctccctcggggccgggccctgctgtgcgtgtcagggagcagcagccactcagcagcctgagctccgtgctgctctaccgctcagcccctgaggacttgcggctgctcttctacgatgaggtgtgtatgtgtatctccagtgagagggagggaggggagatggtgagcacaggttggggccatgagggcagggtgggaaatgggtctaggaaccctgggcattggtggcaggatggcacttacagatgagagaactagggttggaggaactgggggactctaggcttggatgaatatcaagtcagggaggcagctgtaggcaggggagacacctggactgggagcccagccatttagctgggccacgaggctttcagtgaggtttccggcagctttgagttggcaggattgggccggttgtatgccagccgtttggcctttgtgaccaccacctgaggagatacggttactggtcctatttacaggtgaggaagctgaggcttggggatgttaaccagtttgcccagtccaaagtggtggagccgggaattgaatccacagttccctgaaattgagcccgcatcttctgtacaacagggaagatgaaaaagacaggtcctctggaggctttcagtaaacgtcggctggattctgtttacaaagctcagagtcaggatcttttatggggagtgacatgggcctggggaaggggagaggcactgagccaaggtggagacagtgaggccttcgcagagacctcccttgtacccaccctggtgtggtccccatgagcctcgccttgctaactgctcggtctgccaggtgtcccggctggagagcttttgggcactccgtgtggtgtgtcaggagcagctgacagccctgcttgcctggatccgggaaccatgggaggagctgttttccatcggactccggacagtgatccaagaggcgctggcccttgaccgatgagggtcccacgctgaccttggccctgacctcaggagccacgctgtagacattccctctcctggtctctgggtctggcttccaggctctggctgtggatgtcttcagcctctgggtgctggccagtgaggtcccaaatgacccagggcttaagggagaggcgagagaatgatctggcctcaggggacaggccacctggtcaggaggaatatttttcctgcactttttctcaggtatcaataaagttgtttccaactcataggtcatgtgtggtacttagagtcactcataaggcctgcagttcccctaacctcttctgacagaagctatcccacccatcacctttcctgaatgggcagctccaagcagccttgtttgtgccatgagaccccatctccaacccaactgtggtcccagcatgggagatcaagtagagctcctgacccacaggcacacagccccaagctggcagtgacttgtcatgtggcccggcatggaattgctgccaaacaagtagctgggccagatacggtcctgctctcttgaactttacatggaaagtagtgaggacttcaggccatcgcagagggtgtctggggagagggtgtgtggagttgagtggtgacctctggtgcttcctgccattgccttctcagcaccgcctcactcagcctggaggcctggatggtcagccccactccctcacctcttgtctccaagtctggccccagtgattggttcaggaatcctcatgtgaattcgtttggcttatgaagccccagcgcaggcatttgactagagcaaccaagaaggaggcaagtttcctctcagggttgctgtgaggataagcctggagctgctggctgtggggaggcgctttcctaaagtggaaccatgagagagaggaagatggcccagatggagagagcagggccagactctggggatatctttgaagcccctgggtctagttgtgcccgaagacagaaacccctgtgactttaggtaacatgatctaaaaaagaagccctcccctccctgtttctatggcttaagctaattcgaagcaagtatgagccaccaagagtcccaactaaacaaaccccgactccaacttgagctgggctgagatctgtttcttgtacccaagaatgaacacaatggagatcattacagccacacagttgtgcagagaggctctggttcttggttccgattctgaagtgaggcagaatgattaatccagctcactttttgtgtcaggtctatggccttgaccactttgtgacccgactgcttggtgggaacagcagtactggggctgtgtcactggggccttctacctggaaaggatgtgggaagggttgcctggcctaaccagcccactacatctctaaatccatggggcgaactttttaaaaatgaaaaagggtcattgaaaatcctgtacttttacatttatttaaaattatttaaaatgtatttaaaagaatgtatacaggaaaaaaatgtatactgtacttaagaatgtagagtgagttgctctcatatgcctgaccccctaactctagattcaagcattcttacccaatttttgtgtatctgcttaaaatctcagtgcatgtacacaattttccccagaaaagggtaattaagccattcacttccatttagaaaaaagattggccgggtgcactggctcacgcctgtaatcccaacactttgggaggctgaggcgggcggatcacgaggtcaggagatggagaccttcctggctaacatagtgaaaccctgtctttactaaaaatacaaaaaattagtggtggaggtgggcgcctgtagtcccagctactctggaggctaaggcaggagaatgatgtgaacccgggaggcggagcttgcagtgagccaagatggtgccactgcactccagcctgggcgacagagcaagactccgtctcaaagaaagaaaaaagatgatttctaagattagtttctccctggcaggtctggcctgctttggcgggagagtagggggggaatggtaggagtcatggaaccggctagttgggaaatgctggctggggtagaggcctcttggaaacagctgcagaggctgagggcccagaaagatctgtgcagaggcccagaaaataaattcacctacttctgttttgctcagaactgccctcaatttttaattgaagcaaattaaaacttcccaaaaatattagtccactttcttggcaaggtacacagccccttctcagtcagtgattttggaccatctgcaaacaggagctggtactggtcctgaggaaggcctttccctggccagaggctgcccttcacaccaggcctgtttgcaggcacttccccagaagccgggtcaaatcaggccatggtgcagatggggcagaataatctccagtcattcaaggtgattggtagagaagtgcgaggcagggagttggaagaggagttccttccatttctttgtgcttaccatctctgtgaacaccttgttttctagaacagtgcagtggagtcttctgcagtgtttatgcaaaagtgctctttttttggtgacgcagaagacagaggtcaagtgtgaggtcatcaccactcctggaggtgtctgtccctttagttctgcacctcactaggagcagatgaaccaggtgcacctgcccctctgacccttccgccctctgagcaaaggtgactgctttcccactggtgctcagcacaggtgtcagtaggaggcccttgaccctggacaactcccagagatggattcctccattcagtctggccttttccctccagcaagtgcttattgattgcctggcctctgtttggccttgggcttgctggcatgaaggacgcagacctctggctcctggaaagcagtggagagaagggatcctctcacctgaaactaaatccaagggagaagcaggaaatcagtggtggggaatgaagatgaggatgaggaggaaggggcacagaggtggtattgagggtttttttttttttgtacttagaaaaattaaaaaccctctgtattataaattcaaaaattatatttaaaaatttatataaggccctaggggggttagtgacttaactaagtgatagaaaaatcaatgactaagacttcagaagcagggagcaggccagctcgacagacctgtctctttttctctgtaggaaagggtctgtctttgccacgtggaggcgacatcctccacccttgtcaagatgctgcggtagcttctgaagagaccctacccagattgtttggctgtggttgaaaattcagctatggttctgtgtgttatgttttgcccatcactgagcacatgcattatttcacatctatctattcatctactcaaggggtggtgtggtgtggtggtataggaaaagagatggtggatttagctctaaaacatccagggttatgccttagttttgtggctccatatttaatcacaaaagtgctcacccttgttccctcatctactgcatggggatgagactgatcagtaacttacctagttcacaaaattgttgtgtgtaatcatgtatatggaagtactatgtggtccataaaacatgaaataagtgctggttaaaaacctgcctaggccgggtgcggtggctcacgcctgtaatcccagcactttgggaggctgaggcaggtggattgcctgaggtcaggagctcaagaccagcctggccaacatggtgaaaccctgtctctaccaaaaatacaaaaaattagctgggcatggtgatgggtgcctgtaatcccagctacttgggaggctgaggcagggagaattgcttgaacccgggagacagaggttgcagtgagctgagatcgtgccattgcactccagcatggacaacagagcgagactccgtctcaaaaaacaaagaaacaaacaaaaacctgcctattacttatcacaagctgctttgttgcctggaaatactatttgtaatcaaaagagggaagggccaggcatggtggctcacgcctgtaatcccagcactttgggaggctgaggcgggtgaatcacctgaggtcaggagtttgagaccagcctgaccaagatggtgaaaccccatctctaaaaatacaaaaattagctgggcctggtggcaggtacctgaaatcccagctactcaagaggctgaggcaggagaattgcttgaacccgggaagtgggttgcagtgagctgagatcatgccattgcactccagcctgggcaacagagcaagactccatctcaaaaaaaaaaaaaaaaaaaagcctgcattttattgcccatgtgtttctaaggggatatgtcttcagacgcttctggggaaaggagtgaaccatagcatagttgttgttcttttggcccatctttgtcatttgattgttttggactcagtgacttttccattctccacaaaaacattcttcagtttattagttactataattacttgtgcacttgctttcaattccacagacatttattgagctcttagaacgtgccaggatgtatgtgagaagatgggggcagggatccaaggatgaatcagatgtgctcctgcctccaaggagcttatggtccagggaggaaacggggaaaggtgccctggtggtggtcgcgaaggctgggtaaggttacagtaggagaatactgcgatagtgactgtttctgatcacctgctctaataattttgttcacgttatttcactcagtacgaccaccctgaatgaaaagtgtgatctctatttcacaggtgaggaagctgaggctcaggttaaatacagggaatctcaccaaggggatactagatgtcaaacttgggccatctgtctggaatctgtgctctttcctctcaactgtgttgcctctcaggccttccagagtgcccaccctacttcccccttcagtccctttccttttttttgactggagtctcattctgttgcccaggctggagtgcagtggcacaaccttggctcactgcaacctccgcttctagggttcaagcgattctcctgcctcagcctcccgagtagctggtattacaggcatgtgccaccaggcccagctaatttttgtatttttagtagagatggggttttgccatgttggtcaggctggtcttgaactcctgacctcaggtgatccacctgccttggcctcccaaagtggtgggattataggcgtgagccaccatgcctgaccttcagttcttttctatgcatctccttgtggcaccaacttccagggaaaccacattcttccagaaaaacacaaaccagatcatctaaatatccaggcagactgttctttcctgccatagggcctttccaggctcttccttctgcctagaatgttcttctctccccacttctccaactcacccttcatggcatggccagttctttcgttcccttcaggtttttcctccttgtcaccttcttacagaggatgaccctaatcctacttcctgaatgttcactgtaactgtcctttcccttcatggcctttgccatgttttttaattataagttgtgtttgcttgtttgttgtctttaaggtacccaagaacagggaccaggattttttcaccaatatatacgcaacctggcatggagttctgagtgagtgtgtgagcttcagtttacacactgggtgcgtgaaatgttacttcataacactggcaaaacagcctgattttatttcaagcccccatcccacagggttagcaggactcactgacttcactttctcccctctctgcatcttggggaccctcctgctttgctgatggggaaggtcaaagggtctgctcctccactccttccccatcttccagccaagacactgtctctcttgctaaccctcttcctctttcttccttcacaaacctcccttggttccctaaagcattgtctctggaagaacaaaaggcagaagggctcgtaggcgatttctgctttctgtcctacccattcgccccaaataacaaaactcgaagcaggttacctgcttgggtaggggcagaagaggagcatgcaaggacatagatctgtatctcaaaattctatgttagccaaatacatcagtaaagacgggagctggaaggtggattctgcaggggtgggagaaacttcagggacattggtgctgtcctgagattggatttatttcaaagttgagtccaaatttaccaagcaacccatgaattatgatgggataaaccaccgcagagtaacaacgatagtaaataataagaatgtcatttattgagcacctattttgtgccaagcattcaactggcattttacatatagcatctctaactccagagtctgagctctttctcaatgccatgttatctcttgtgtaaaaataagatcttactcaccaccaggccagtcagcagcaaatggcactgggtgctctgctgtggggagtggggagatacttttggcaagagtctaagtgaaactggggctagctcaacccataccctgctctattccagaaactctccagcctgccaagttaggttttccaaggcaaagattggtccatgaccaaagagtgtcacaatctaccctggtggggataaaagtcattctggatgtccccaccttcttagagtttgcaattgtcatatttaatatggctcttagaattattgctctggtaaggacaagcttttgcttattttacgtgtgtacatttcaccattttttcacagtgcaagttatttgaggactttttggtatttttgtctcttagatttgtagtagtattgaaactagctaacagtgttgagcacttactataggccagtcacccttttatacaaatgaactcatttcatcctctcaacaaccctgttattattgccattttacagataggcaatctgagacccagagagggcaaataacttgatcaaagtcacacaactgtcaagtggcagaactgtgctatgaactcaggcggcttggctctagaggtctcacatttaactattcccctatacagacgctagtcacaaagatgcagtctccttgaaaagtcgatctgggaagttagtggtctatttcagtttgtgcccatggcatggaaggtctaacagttgtgggagggcatcaagacatggtgggggaggctgggcatggtggctcatgcctgtaatcacagcactctgagaggtcgaaatgggtggatcacttgaggtcaggagctcgagaccagcctggccaacatggtgaaaccccatctctactaaaattgcaaaaattatctgggtgtggtgcccgtctatagtcccagatacttgggaggctgaagcaggagaatcgcttgagcccgggaggcagaggttgcagtgagccaagattgtgccattgcactccagcctgggtgacagagcgagactctgtctcaaaaaaaaaaaaaaaaaaaaaaaagacatggtgcggggaggtactgtggtatgtgatatatgaggataaatataggacataaagccagaagcccttgcatctgcttctggccatgttgcctatgagccttagaccttgggcaagccaattaaacttaccaagcctcatttttctcacttgtcaaatggggttaagatgctctaccacagagggttgttgtgaggaaccaatgagaatatgaatattaaagtggcttgtaagctggaaagcactacctgcatttaaaataatgaagttatcattgttgttatccttaagagcactggatggagatgatggcgaatgacacagtaatcataagacaggcaggggctacccaggcctgttaacaggagggccattccctcacatcctctctgccagctccttgatgttggcatcactaatgtctggtgcctgctcatcccatgacctagacttagagcccattcccctgattctagcagtcaggatgactagttggaaataacagccactttaagctggaagggaatttactaaaaaataatgaggattagagggtattctcgggaggaatagagagcaaggacttaatgaccagctataacatgagaacttctctgccttccatgcctgcagaagtctgagtctcctgtgcacaatgctcacttctaaattcaggtcttgcacaggtgagtctgactggtggaaccgaggtcagtatctgtgccctggctgcaatggttttctggcttctatcttggcaagagaagacttatgagaaatgaccaaaatgtaaaagtgggttttcaaagatctgggtggccacagatgacagatatctgccatactggtctagttcccagcacgctggacccgcagagtgatttcagggaacagaatcagaggaatccacccgagggcttctggcccattcatggggagcccagagaacggtgtgctttgcctccaaatctgggtggtgtggcgggatggctcctgctccttcggacctaagggacaggctgtggtgctgctgcatgtgcagacaagtgtcctatgctgccagcatgcagggtggggacattcctgtgagactggactgtgaggaagggtgtgacagttggctactgctctaagctggcctgtcgctggcttcagcctttgctgtcacctttcctgtcaccatttcagtgtctacaggctgtaagctagaagctgacacatacccagagtggccatcctttgtgcatgcaaggagtgctcttttgtcacagaaatgaagaccccatcgggaacacactgtaggggactgacaattacaggtgcgccgcaggcaggatgtcaaagacgagagcgggcctaatgaaagcatgcgtttatgtctaataggatgagttggtgggtgtcagcatcatcttactccccccagcctggaaagaaagagataaacatgggtgtctaaaggctcttcaaggggagattttactccatcatctcagaggggtggaggagagaggaaggtctgtaagggtagagaacgaagcctcagactctgggtggggtgcgggtctccaactgaaagaatgggggtctggggctaccaaaagttgagggcctgtgctcagcatcctctctggggtggatggaacctcagagggacaagtcctgtgacacccttatggcatcttggtgtgcaggatgtacatggcctggtacaccaggggtccctggttggcaagacccttctcaggctgtctcagtattaaagtaactgctgtctgactttacagactagaggagcggggctgggaacacaatgtcgaggtggattgaagaccagagcccctgtgcaatgccgaccaggaaaggttccaaggctcttgagtgtctctaaggacgtgaaggccctaccaaaacaaaattcaaggtagggacttggaaccacattgcctggctcagaggaataaagaattgggatagctctggtttgctagggctactgtaacacagtatcataaacccagtggcttaaacaatggaaatctactgtcttacagatctggaggctagaagccagacatcgaggtgtctgcagggctaggctctctctgaagggactagggaaggatctgttccaggcctctctcctagctttggtagttccttggcttgtggcagcataactccagtcttcacaaagcgttctctgaatgcacgtctctttgtccaaatttcccccatatatatatatacatatattttttttttttgagatggagtcttgctctgtcacccaggctggagtgcactggcacgatccctgctcactgcaacctctgcctcctgggttcaagcaattctcctgcctcagcctcctgagtagctgggattacaggcgtgtgccaccacgcccagctaattcttagtagagacagggttttaccatgttggccaggctggtctcgaactcctgatctcacgtgatccacccgccttggcctcccaaagtgctgggattacaggtgtgagccaccgcacctggccaatttccccttttcactggaacaccagtcataatggatgagtccacccttatcttaacatctgcaagaacgttattgccaaataagggcacactctgatgtaccaggggttaggacttcaacgtataaattttgggggacactactcaactcccaacagctgggtctcccattctgagttttggggcacagctgtgctctgcctaggcat

SEQ ID NO: 476 - DNA, 170044 bp, Homo sapiens
ttcagaataaaagactagtttgagttaatattgagtgccttggaactgaattaagatctattaaatttcccataaggtcaagaatggctccagagccgctttggtcaaacaactccctggaattgtgtactccagtatgatctttttggaaatatctatttcttctgctcttgatggtgggtttcacatgaggtcacaaaaaggaacatgtcttgaaactcttggccagtgtttctcaaagcctgatccctgtatcagaatcagctgtgtgatttgtttaaaatgttgatttggaggcactgccccagaactactaaatcacagtttctagggaatctgcaatgattatttgaaatcttctgtatacttatagccctgttccacaacttcctgcctccttcctagtagaagaccttgctttctgcatctcagaaaaaattgaaaccatcagccagaagaatttctctgatatccaaccattgagtctgctagactgccttccccctttgtctgccatcttcctgctgtactctgctttccactgtcctgctttctcagaaattgtccactaataattctctgttttctctcctgtgtattcagctgtgccgtctcaaaaggattatccttcgaggcaggaaattatgttcaagtctattttattgaacaacaaatacaaatttaaaatatctcccttggtcccatactacctctagctaccatcttctctgccctctacttctaaactagccttttagaaggagttctgtaggtttgcatttctatttctttcttcatcatgtgttcattcttcagctcactgtgatctgcttttaactcatgactcctttcaaacagctcttggtaaggccaccactgatctttttatcattaaacttaccaggcattttctatttcccctctttctctattaattctcagtattcaacatcacagaaatcttttcttggaatattctctttcattggcctccaaggcatcacattccctgttttcctttcttctctctgggcacaatctgactcctcttctacttagctattaaaagttgcagttgattacccagtgctatcacacttggcaagtttattcatgcccatagcatcgactgccatctgtaattgaactgcaaatttatattctcagcccaactgcttagttgatgccttctttgacgtctaaaagttatctcacatagcatgtttaaatcaaacccataatatttctgcttctctcctctcccaagcttggtatcccaagtgttctttgtttcaataaatggtggcatcattcaactagttacataagaaaagccaaattcacccttgaagcctcccctttccttacagccagtgccatcaccaaacaaaagtttctcatatagtttctaaagacttctaaaatccatccatttcctacccatccacacccaccaatttagtccaagaccccatctcttcttccttgaatgataacaattgtcttctaatttagcttcccttcagctggagtgatcttttccaaaagcagattgatcctaccacttcctaaatcttttggtgacttcctttgctaattcttatcatggcctacaaggttctccaacactctctgcctccctcttttccagcctcacctactacgctctcctccctcttccaagcaggcacattgttcttgttttttcagtacctcaaaatgctatattctcgttagtcacaggactttctccacaccaagtctttcccttctctgtctaatgaactcttgctcttcttcagggtctcactttctcagggaagattttcctgacctcaagttgtggatccagtttttttgttattgttaccggctctcataaaagagcctttcttccattaatcatccttatctcagctgttaattatactctcattagtggggtgatttgattagcatacatttccataagcctgaaagctgttttctagtgggaaccatgtctgtttttactcctgttgcatcctgatgccagcactgggcctggtgtgttgcaggagatcaaagagtgaaggaatgaagagctaggtgccctggctcgaaggatgctttatatttcttgtcacaggggtcatcaaagattatttctggtgtatcaaagcaccaacattgccctccgtccatgggaatgagttatattctgtgaagaaatatttctagggttttgataaatacttgttgaaagaatggattttgggaaatctcacagttagcctttctcttattatgtagccaaaaaggaatatgcagatactgtgtacccagctcctaaccacatgctggaggctgttcctgtcatcatgatatatcatggaacccagtactgttatctaaagatggttaaaactgggaagagttgtgggttatagttttttttattattattttttacttgttagaagagaaaaatctatctgacttctgctgtttttgtctcagttgctttttaatttccttctcgctctttcccactgcccacataaaaaatattgctctattatatagacttcttttcttgcttggatatgaatctgagttgagcataaaagggaagctgtaagtaatcaacaaagccataaaactgggttgaatgttaggattgtataaaaatattttcctataaaatgctctgggaattgttttagaatttaggaaacacaaacaattccactctgagttggacaccactcaagattagggcctcccagaagtcagccgctatggcatatgtctgaaaatctagaaagtgaaagtgttagattttagttttgatttggcaaatttccataaaggaagactaaaacaggaagtagtaggtgggggatagtgagcttccttccttcagaggaatagaattaaaatgttggaaaaaataacattgggaatatccagatagggcaaagttgagaagtggattgggtggtaaccccatctccctacagctcctcccactgtctctcttccctctggtggtgctgaccctgcatccatgcactcagtcagcttctcatgcccagtcctttgagaggctaccttgaccacgtgaggcaagcctgcgtgttaggaatcccctccgttcacctgctcatacttcattctttcctgtcaaagcccctcctcatcgactttccagcccattttctgtttctattttgcctactctggtggtgccatgcgccgtctgcactataatcactgacatgcttgttaaaatgcagattccttggcctagccagcactcaggatctctgggaatgaggccaggaatccagattttggccaacttactaagtaaattatgcacattagggtttgaaaaccattcacttggtccctttagtttttaaattcctggttcctttgcttgggtactgagcttacctttctttcctgaatcagcagtcctgtgggcagccttttaggtaattttctggctcatcttagcctcaggacaccctcattttctcaggcaatcaagcagtcccactccacactcctgaccccaatatctaggtgagtttggccttatgggcaggacagggatatctaacttgttagttgtaaacatgagatattatcctgcccaatgacatttgtctttctaaaagaagactttattctccaaacaaatagatatctggggaattttgtgcactcaagactaaatgtaccaaggttaatttcagtgggaaatcttgacaagcactcttcaaatcatagttagagtctggctgcacatcttacctaatcgtagggatcactatagtgactgtgaagacaatttaccctttgaaatatttgtccaatgatctaatgggtttatggaagcttgctgcttcttgaaatactaccatatcaactagcttcctggcaatgtgtgtagggaggtcatgccagcctgtgttgggtcatctttaagaaaaggatagaggtccaggaatatgataaataaaagagacagaagaggatctttcttaagaccttgggcttttggaattggtcatcactgagattcacttctggcaaagaaatttcagagaagttacttcaactatgccccattgttctcaaattaaattaaggacaatgatactgatttcatggagtatgaggattaaatgtgataatgcacatacagtgcttggcacaagatctacagagtaatgcctgttgttatcgtagtcattattataacatttgaaatggggagagggaaggaagcagttttgttcttccacttttcagagcttcaaacttttgggagcatacatttctattttcactcatgtgccttttcctctatgaagcaaggaccttgggggtatcttgcactgtgtgtcttttcccaccccatttagtatacagatgaacacccaggccaaagagctctgcagcatgaggggaacacacaggaaaggcaagggccgcctgcccttggtgatcactggggatgagctctgaggtcctgcatgctggtgtagaacagctgtagtgccttcttctgttcagctgcttctttttagtgttgggaccaacttgggcatcctgctgtgaaagccatctcagtttgggaaagtgggtgagagggttagggaataaagggagagtgtgggtgagtgactacatgtgatgggtaaggggctttggagagatggataacgggaatttgtgagtagggatggatagattctcattgtcttaggtagctggggctgctataacagaatgccatagactgagtagcataaacaatagaaatttatttcctacagttctggaagctagaagtccaaggtcgctgtgtcaatatggtcagtttctggtcagggcactcttcctagtttgctgatggccatgttcttaccttgtccttcctatggcagagagcagagagagagacacaagctctcttgtgtctcttataaaggactaatcccatcacgagggcacctccttcatgacctaattacttcccaaagcccttggctcatcacattgggtgatggtttcagcatttgaatttggggaaggacacaaagctgcagtctataacacatatcaagtcttctattaattagtgcatcagtaaagcatctagagtagtgagataaaacctagagatttcagcatagagagcgttgggaggagagggcttccagggttgggagcagtgtcagatgaaagagtagaaaacaaacagaaactggaagtaaaaagaagaaagaaaggaaggaaagaaggtggaagagagagcaagagagagagagagatacacaaaatgtagggaacctaattttgaatctgtatgaaaatctctgcagctactggaatatgtacagctaacatgccatcagatagtgactgcgacagggcagctggcccttagggttcatgtcattgctgatgttgtttagtcacttgtttctaattgtcagtcttttccccttgcaagctgcccagcttgagagagaagccaggaccaaagtatgcaactccttgatgctgaatttggtgcttgtgagatatgaggctccatggcctccgtcctcttcctctgttttcctgaactgggtagaaataaataacagtgtctcagagcattgcctgtggggttcagagaagcaatttctacaatcagatgctcctttcacctttgaagatgaaggagaagaacatacttggtgtgtccccaccatacccactgtgctgggagccatgactgaaatactgctcttggattctgagctcaggagctccattagagagtattactaaagccagttgtggtgcccagcgctgagcactttcattgtgcaggcaggccacacatgcctaggaataagtgaaaacgactttgcctctgcacgggaatgtctgcactccgcatcctgtgttatttcttgatttataatttcttcaattcgtagtcttccctcagctaacaagtgaagagtgagcataccccttcatcatgaatttggcgtttttactgccacaaatattttaaatgacattctacagctttaactcatctgagtatctgaggtgagctatgattttattccaaagctgtttctagcttcccagcaaccattctggttctctcggggctcatctgcctctcaccgctctgaaagtctccagttccttgccactcttttataaacaatttaaattgtctcctcctcctggggagcagagggtgaatgatttcttttgagaagattcagctttaattgcacctcttattaaacacacacaatgtttgacatatgatttgtggggatcttggaggggacttgtggattccttaaagcttatccacatacccctattgaagatgcctcaatttaaataaaacatctttattacttgtttctgatactaactgtgttggatagtctatcttctcaaaattccctctttcagtgcctttgcagttgttgccactacaattctgttaccagctgcttattgttcttttgatggagctgctaggggtgaggtggcacagaggataggcaacccaaggtgtaggaggcagactgccagggctcacagggattatcactgatgtttcaaagcctgccacaggtttcctgtcttgtgttttcaaacacagggggctggatcaaagcttgggtggtagttgtggaggtacatggctcagatccctctttgaggaagaatggcagggcacttggctgacagcctccagctgcagggcttcagcatccaccatggtgttcaaacacagaacactttccctagagagccccagccagcggctgagcacggcagggcatcaggcctggccattctgttaacgtgcaatgtctctctgggcaatctttgcacgtgttgggctgggagctgcaccacagtctgaggctcttcctaaccaccccttttttcccaggtgtcagattggcatggtggtttgaaggctgtccctgagtacttctgctttctttcccctttgtctttctcagatgttattccccccaacctcctgtcctacgaaaactcttgtgcttataactctgttgtgtctgcatcctgacacagctttattcataggcaacatcactgtcatttcgcataatcccacctcccttcccagatctcaacctgggaactgttcccacatcttcccaacccatttcatcacagagttaagagtttactgaacattgattccatccttctagctatgcaagttattagggtttctagtaccatcccatttagcatcctataggatgtttaggacccctagagaagagacagaggcacgagagagtgaaacacatactttatttctgtataaagattctttccaggagaccaggctggaaaacacggaaacctcaggaatggcccctctccacttatactcctctcctcacaaatcaggccaatgaggtcagttcctgagtcccctttctccaggattccactcagtccttgtctcttagtgtcctgttgggggataaggaggagaaggactcttgttctctagcttctccgataaaggcccccccaccgcccctcaattactgtggtctaggaactgtgagttcatgatatacatcagggctcctccctgagaaagcatgaggaggaagaggaggaagagattcacacaatacaaatatcacagtgacagcaatgagatctcacattttggaagtcacgtaacaaagatggttccttgatatttcatattctattactactggacattacaccaagtaaacacacttggataaacacagggtgatgcatttctagaataagaatgtgacccatgcacagtacaaatcatggtgtttcttacatgtgggagttgatgacatttttataagttagtggacattggagactgggtcagaggaaggcttgctggcactgtccaagcagatgctttgccatattggaaactgcccggaccacccaacattccctcttactatgcacagagatgatactgttcaaccaaattcctttaggtcccctggactgactgccagctccctttggaagtaccccagagaactctcattccagaggctctccaaaggtcccagtctttggcttgactgcccatgttgagtgtgggtttttagaattctgtggagaatctgtcctctcagatgcctccaagactgctgggcagcttagactcactaggactggtgagttagttagtgatggccaataaggtaggctcttcaagagctgcaggggctgtgtgttcccagttcagggcaaagtccagaggaggcactcagttaatcctcgttgagctcaactctaaccttctcttccatagatggggtgtccccaacttcttgacaccatcttctcaggtacttctcataatcatgttagctctttacattcttccaaagtgagtaatccatacacagcaagattctctattggaagtatgactaatgcttagggcactaacttttgttgcttctaaattttgtcttccatttatatatctgcaatgatctggcttcacttagtttatttaaaactttccatgctgctttagagaatgtagttcttgaggttttctggcttatactgtttcttcttcccccaggcctgtggatgccctggtagaattagagccagcagggctggcaaaggctgtaaaccatgcattattctccccttaatgttatggatgcggcacatgtgcatccattatgcaaactaccaggaggacattcatggatgttacatgaagcttctgcttccagccatatctggaaaaaacacagatttgggagacagaaaaaaaaacaaaacaaaactgcatgctcaccttctggaaactctaaatctaaattaggatataaagcattcagttcatggctcttggaagactgactgtcctttagggttgatgagtcattctaccccttagagacaggaagctggcaaagccatggagcagggaggagacattcagagagtctgaagggaagatgcaagatgccctcttcccagaagtgcagctgcaaagtgcagccttcttgcttgtcgcacatatgagcacgatgctagtgtaaaactaagaatgaaggttagggcccccaccctaaaatacccaaaaggttaaagcagggagcccacatttgtcttctctgacagtgttctgcagctatgaaattctgcctgctaaagctggatggatgcaggccttggcatgaagtcctctgctctgtcaaaagccaaaaccttccatgagaaggaatgtactcaggattttaagataaatcggagaatgtctgagatggatagttacagatggccttagcagttgctacatctccaggaactgggtattagttacaagactcactgctcctattcttttctattcttttattcttcgttttgtttttttttgtaaaacaaacaaaaaactcatacaatccttgaaccacgggatgttaagattcgaaggaacacttagattatctagttcagtccccttgtttacaagtaggaaaagagggtcaactacacattaaatgtagtgcaagtctcccaattcctggtctgtaagagaactagcaggtatcagtggacatattctgcttgcgtcggctgctcaggacagtcaccggggacataatgtggaagcccgaggttctcaatctcatgatgtataaatgtactgaaatactgagatgccaaaaaggggaatacatatgtttcttttcacagatgcttagaagacagggctaaatttttcatttagatgttatgtggtgccttcttttgttcaccctgtcaagcgtaggctggggtgataggagcctccagctgcaggaggctaatctgagataactttattgaagtaacacggggctccaggaaaatgagtcttccgggtccgcagctgtgctgcagaattcatcctgaaatgagcactcgcatgcagccaaagtcacttccagaatggaatgaatgggcttttgggaaaagctggtccgaccttttattttacaggctcagcaaagttcagtgatttggtttgagtcacacagcatgagggtggcaaagatagggaagaattgagattttttgactcaaggatggaatgttttccctaacccatactgaccctttttgcaagtcccagtgtgagggtgtttctgatggttccagatgaagggaatttccatgcatgaagggaggcaggtcaaaggcagtgggggctgcacctgccaaaggccctgtggcctaggagagcacattggaggagaagctgaagctctctgtcatggtcttggagtcacttcgtgaagagcagttggaggtcaggtccagggacgagggtgtggccttggggccgtcctctggctcctcctcgtgggcccccaccactgtggagatggtggtctccaggcggctgactttgtacacactgccctgggtctggagataccgggtggatttcatttccagcccctcatagtcgccggcgctgatgaaggggcagcaccggaaggcatgcttgaagcccagacggaacctggagagcgagcagatgaagaggtgaccctttgggacggcctgctcagagggctgcccaccactgcatcagcttgttaacacatggacatacccaagcgtgattctgttattgtttttaaaattcaatgacagctggagatgctgaggccaaaaaggcttaagggtcagtcaacaaggtcaaatccaagactagaaaaaaaaaatccaacactggaacaatctttatgtgaaatacgtctttactgggggtggccctgaactatgctgtctcccctcacatggggtcagcagactttgagtcaattctacctcaacaaaacgcattcaccaagtgtttactatgtgcacagcactgtgctagttactgggtggtaaaaacacatatcaagattcagtccttcccctcgagtagcctgttaactgaaggaggactctctgccaatcatgtttcttcagtgtgcctcagtttctctggttgttaaataggaagaattaacctttacttaaaggcgtgctgctagacttaacctaaaaaaagtgtaggtgggtcatgaaactcttagaaataagggtgaatgtgtcagttagactaacagagaccctttggacaagttgaagagaatgtctttccccaaatttctagtacctgagtgtctaattcacagaaggcaccttacaggctgaggactgatggatataaagatggtaacaagcattttattcctctcccgcctccttccccatccagaggctggtggtgctctggatgacagactgtgctgcagccactatgtgtccctgcctgcttttgggagccctctgcaccccatggtgaattccctaatgctgaccaccattctggatgggctctgccttctcttacttctctgacattggcttctgccatctgcaggatggctctccccaacccctttgactaagtgagggcaggaatcaggcctctggggtcacaattcctttttgccttaccttgtcctgctggaactgctggaagaaaatgggtaaagctgctcagatcgtaagatggaatgggaaaaagacagtgagagatcagagagggcgaatgtgctctgtggggggatgaaattctctttctgcatgcatagcccgctgtgtactggatccatagagcagagtgaataaactcacaggccatggcctggagcctggatccagcttgcagacctgccttacatgcattaaccacagaagtttttaattcccccactagctgccagtatttatgaatcagaagactttggacaataatatggatttctggttccctttggaaaagaaaaaaagaaaatcagtccactccgggctcccattcctggatggtgataatcagccaggctgagttgtgtgatgataagttagctgcagtccccacttgtccctcttgtctcacagctgggtttactcatttaggatggccgcttggccactgtgtatgtagatggtcttgtggcccctggagagctcatggggttgggatcctcacctgtcattgaggcagcagtagatgatggggttgtacatggtggagctcatggccagccacatgatggccaggtagacctgctggataaacttcttcaggtagagatctgggttgatgtagggcaggaggaagaagatgtggaagggcagccagcagatggcgaaggtgcacaccacgacaatcatcattttgaccacctggcaagagggtgagacaggtgagaccaccagcacatccccctctctcacggctgcttcctctctcctcccacgccctcactgtgcacagtatgggatgaagcgagaagtatttaaaagacgccccttcaaggaggagaaaggatctttactatatggtgctacaagacttcggttatgtcagctgttctcagagtgtggtcccaaaaccagcatcatcaccatcccctcagagcttgttagaaatgcaaattcttggaccctatttcagacttactaaatcagaaactctggggataggaccccaaattctgagtgtgacaaacccttcagatgattctgatgcatactcacatttggggactactgtgttacattattcttcatgactggaggaacacagggagacaaattaatgagcaaaggtgaaagggtgttcaggaggaaaaggcctggaacagcaggctgggtgggcgggcacagcagaaggggtgggacaaggggagatgcagtgagctagggcaagctgcttggttttgagactgaaggggagggaaggagaagggaaaagatttgactagctgcagtcagagagtgccagatgtttaaaagcgatttaaaaggttttgtgaatactggatactatgatctgaatgtttgtgtcacttcaaatttatatgttgaaatcctaacccctaaggtgatggtattaggaggtggcctttgggaactaattaggtcttcaggtcacagccctcatcaattaaattagtgcccttataaaataggcctgagaaagaccccttgccccttccaccatctgaggacttagaaagtgccatccatgaaccaggaagcaggccctcctgaaacaccaaatccgtctgtgctttgatcttgggcctttcagccactagagctgtgagaaatcaatttctattttttataagctcccagtcaaaggcattttgttacatcagcccaaatggactaagacaccatgcgatgtaaccccttcccaaggcatctttagcaaagaactctacagcattcatacaatgctatgcagagaagtaccaacagagaatactaagcaaagaagtaccaaagaaaaaaaaaaggaatgagaaagctctttatatactgattttcaaaaatcttgtcaattttaagtgaaataagtgagaacagtgtgtatttactatttgtgtaaaaaagaagagaaaataatatatatttacttatttataagtgccaatagctagaagggttaagaaacagataacaatggttaccattgtatgcatatctgtgtgtgtgtgtgcgtgtgtgtgtgcaagcttgggacctgggtagatgacagatctagaagggagagaggctttccatgataagaattaaatttttttaaatgtttcgttttgaactaattgaaggccctcgagaagttgcaaaggtggtgcaaagcagttccaggtagtcttcacctagcctcctccaatgatatcatcttacataaccataccacattatcaaaaccaggacactgaccattcatcaaactactgactatatttgggtttttgccagtttttacatgcactgttttttttggtgtatagatttatgaaatttcatcacaggtatagatgaaaacaccaccacagtcaggatacagagctgctccatcactgcaaagaaactcactcacgctctcgctttgtaggccactcctcccaagccccctcaaacactgactcctggaaacccctgatccgttcttcatcactataattttgttcctttgaatgccttttgatgtttgaaccacgtgaatgtattatcttgtcaaactttaagaagaggaccaaatcactcttcactgatcttttatttaagtgtgcgtgtgtgtgtgtgtgttttaatggatcaagaggttgcaattactctttaagagcaagcgaagtggctcatgcctgtccagccagatctgggttccaaagacactgaagaaagattcctctcctcctctctgttgctccccatacctggggatattttgtgctagctgcctctggggctcacaagtgtgccatcccttctcgacagcctgttgtctgtgccagggtgggttagttctgcctgtcccctgctcaccttgcgcttggcagagacttgctcgtggtagcggtcagaggagtccccggggatctcactggcccatagtgtgattcccactacggtgtatgcatagccaatcaccagcagggggaggaagtagatcagcacagtcacacagatgtggtacctacagcaaggtaaacaggaaaggtcagtatgatatacttattattttaggtttttaatttttgttattgttattgcagtcaaggtttggcagctacctttctcagcatatgccattaataagcttgggctgtaaagcccactccagggagacttgtcacctgcatagggtggataggtaatactaatgaatacactacagaaaacaatttatgtttttcttgtggactttttccataatgaatactcctgttcagattaaaaaaaaagaaaacattgatgacagggcactgaatctgttgtatacccatagcgatttcagttgatgatcagttcaatatcacttgccccacaccaccccccaaaacaagaatgcaaactcaggctacattaatagaagtatagtctctgaatgaaggaagtaattataccactcaattcatacccgccagactacacttatgctcaacttagtgcagggttgtagaccaactagtacgttcagttgagaactaccatgatggttgataaggcccagtttatgctatgtgataagtgaatttatcggtatcagaataattagcctgaatgagagagataagagtaatcctagaactagaattagtgggtgggtgaaagccacatagcataagccatttctaagactgggctttaagaatatatcttcagatagaagctgcctgggtccctgaattacccattggaggacaggtgccaactgactcacgtttgactgggacatgagcaagaaataaacctttgtggtgttaagccactgagatattgaggtttgttacagcagcacaatttatccttttctgttaaagggaaggctccttttcagacttaaataaggtttttgaattttgggaaaatatatttttcttgggggtttgggggtccttggtttgtctggttagttacagcccttttcttagatgtgagtataatggagatactcagaattcctaataataataataataatactaggaagaacagctaatgtttgggggcacttactctaggtcactgtgctaataataatgctaatgatagtattaatagcagaaatggtagttaaatttgagtgttgatgaaaagcacaaagccaagcattttactagcattatcttatttaatccttaagcaaatgattgggtaggtactatgaatcccattttgtagacgaggaaaccacatttagaatttaattaattttcccaaattcacagctggtaaagggaggagctgagattagaatccaggtctgtgatgtcagaaaaccagccttttgtcaatggagaaaagccacccaatgatttttttcttcccctctgtttaccattcatgattattttatgcaatgattttcttccaatgaggaaaacccacttattcactcaatttctcctttgtagatactgtttgcttttaatcacttctttgtaaagccccacagtttttgctacttattcagtccctctgcatatcaaatttgcatttgaagatactcaaagactgcttaagtgacaaatcacagattgcaccaagcagggtgtgagtgcatgtgttctgtgcagacaggctgctccagtctcacctggctttcaaagccctctgaattgtcgcctcctttgggagcctcagggctctccaaccactatggcagggacagcatattgtgtttcctagctgatctcagtccctcctggttgctgtaatggcattgcttgtaagcaaaatgtttggagactacaggggcagggagaacttgaaaacctccaaattgcactgacttctcctacctgaaagaacagccctgcctcatgcagactaatagtttgtgaccaaaacatgttagctgagctttgccgagacattgctacagggcactgagcaagattgggtctgagtgtgatgggagggacactatggtcaactcgccgatactccttaccctggaccagtggccctcaaactcgagtgggcttcagtatcacctggagggcttcgacaaccccacagggctgggtcccacccagagtttcagactcagcagggctggggtgggcctgagaatttgcatttctaacaagttctcaagagatgccgatgttgctgtttgtggttcagactttgagaaacattgtcttaggccaacggttctcaaccgcaaatgtaaaagagaatcaccagggaaacttttaaaatgatcagtgcccaaaggtattcattcaattgacttgaggttgggagcaggaaattacattttagaaacttcccccaagttactgtaatagacatctagcactgagaactgtttcagaccttaggtatgcaagtctattgggactccattgttgtccgtgatttaatgactttattcaagtgtgtattaactgtgttttctggttctgtatctgatactttggcatctgggtccctgcagctcagggagggactgtttcaggcagagctaattcctttggaaaacaaacaactttccacttggatgcctttcatatgcaaactaaccgaaacaaagcccatacttccacttgcttgctttcttgggctcttacagggtaggacactattttcccgccctaatcacccaacggcaggcatcagacaactaggggcagctcctacaccccggagcctgccgaagttattcaaaccagccaatcttaaacctgtttacccggccttgcctgctccttcctgagaaaaccccaataaaggctttcctgtgtggcttggcttggtgtggggccatggcccttcagcttgggaactgtgagtaataaagtgtctttcagtggtaaccatgtcctgatctgttggccacaccatacctgaatacaaaatacaatctgctctttccctttgtgaaatcacagatcagatcattatgaacatgcaaagataaatacgtaaacataatttatcagcctttaaaaaatccctccctttttaaagaagcaaaagttattgttatttatttgaaaacaacaaaaaaaatgggcttaatttcagctaaaatgtgttacagtcaggagcattggtttttccatgttcctatagagataattaaatacaacatagaaataggatccagcaattctatttttaggtatagacaccaaaaattgaaagccaggactcaaacagacattatttgaatctgcacacaacatcattcacgacagctaaaaggtggaaacaacccaaatgcccaccaatagatgaatggacaaacaaaatgtggcttatacttgcaatggaatatcattctgtcaggcctctgagcccaagctaagccatcatatcccctgtgacctgcacgtatacatccagatggtctgaagtaactgaagaatcacaaaagaagtgaaaatggtctgttcctgccttaactgatgacattaccttgtgaaattccttctcctggctcatcctggctcatcctggctcaaaagctcccctactgagcaccttgtgtcccccgcccctgcccaccagggaacaaccccctttgactgtaattttccactacctacccaaatcctataaaatgaccccacccctatctcccttcactgactctctttttggactcagcccgcctgcacccaggtggaataaacagccttgttgctcacacaaaacctgttgggtggtctcttcacatggacgcgagtgaaacattcaaccttaaaaaagaaggatgttatgacatgtgcgacaacatggatgaagcctgcaaacattctgctaactgaataagtcagacacaaaaggaaaagcattgcaggattgcatttatatgatctatatagaataggcaaattcgtggagacagaaagtagatgagaggtttaccaggagttggagggaggagatgggagttattgtctaatgggtacagaatctgtttgagataaagatgtggataactttgtttaagggtgggtgggtagaaaatttcagctgttacagaaaggtcgaaatgaagtatctctggaaatggaaggtggtgatggttgcacaacattgtgaatttacttggtgtcactgaattgtacactataaaatggcaaattttgttatacatattttatcacaataaaatttagtaataaattatgtaagaaaaattcagctaagctggcattctaggtttccagattcgcagtcttttgctcccccaggcacttgacaactacaccctccccgtgccacatccccactgaaaaataaaaggcagatttgatccttggatgagataaaaggttaaacacatccttctaaatattgcttagataaaccccatttacatagaaattacaaatgctcaatccaaacagtgtccaacttatcaaaaattataagtgaatgtaggtcaaatcaatgaaattccattattagaaaacataaaattaaatactttttttgatcttgatgtctttttcagaaaagtattttttaaaatcatatcttgtagttaactggagatatgtctatttatatgtatatatttgttaaaatcattattttagagagctggtcaatgagccagcacaatcttattttgtgtggctctatgcttgctttggctttcattctgctatttcctagatttctgccagttaggattttatcagctctcagaattaatatctgccttgggagaagagatctggggttaaggatgcactataagtgaacataacagcaacagcaagagacagcaacagaagagactggctgacccccacctggtgagatatgtgctgggttgtcatagacctgagagaacccagcaccatgattttgatcattaaatcctgctgatgagcttatcggaactttcagaaggaaggctcaagcaacaacttcatgcctttgttcatccctgtaagcagtgaatgaggcttgacacattttacaggataagcttgctgaatgcagaccatgtagcctcaaatcctgcagattcccttgtccttaatgccacaatatcttggtgctcattaatctaggtttccttatatctcactagtgggatcattgttgaaagcaagaacagtttcagtttctgaaataatcctcagcatttgaaatcaaggttgataggctaattaaataataactaggtgtcttcataatgtacttggaggagactctgggtgccttaaggtaggggaagaaggcagccaagagggcacagctctgggttctccatctttattctaatgagatagttctgctttgctgggtttacatattggctttctgtggatgatattgtttcggggtgggtgggtagaaaatttcagctgttacagaaaggtcgaagagcattgatagaatcccaaccccaatccagtgcattaccattctttgcaatatccataccacataatcatccagaatcttcttgaatacccctgtgacaggctgctcactacttctaaagctgagctacatcagcaacccttggaagcctattacagatgcagactctcaggctccaccccagagggacaaaatcagaatatgcattttaacaagactacccagtaattcctgtgtatgttcaagttggaagcacatagctcttggtcttggttgcacattggaattgcctagggagccttgaaaaattccaatgtgtagatcccactttagagcttctgatttaattggcctgcagtgcagctttgggcaccagagatctagaagctctccaggtgatactcctgtgcagctggggctgagaattactggcattgagacttttgatgctggtagctgcaactgatgcagttcctccttaaacccagtgaaaaaacctgtggtcacgtagctttcacactttatcctatgtcacaaacaaacctgaatctgcaaacctcctgggatggtcctgcaaatgcaaggtgaccatgaacctgctgttccccagagccccctttgcattgagggcttttgaggccatctctcatttgatacaagctgagcagcctcgttcctcctgctcttcctcaaatgtccttcaggctttctctccttctcacagcatggtgctagatgcttgactttttacttcctggaaaaaaaatttcaggtccatgtggcttcttgatagtaaaagaaagcaatactcatgtatttattggttcactcacatctgggtgttagagccaaattccaaagacctttgaaagttctcttgcaggcaggcaaaaattgcaactggttaatcgataaattcagcaaagatttattcagcacctgttctatatctggtctggtgctaggggctggggacactgaggagagttctagtcattgttttcttcttccggagctcacagtctgcaggggagtagtgccaaagagtgtgccatgggaagtggctgacagtggttacctcttcaaggggagtggagacattaaggagaggcacgagtgagcctttttcaaatatagatacaatgtaaaaattaaaaataagcctaaatacatggtccagtgttttgtgcatgtgcgttagtgcataatgcattggtgagatattcaaccaagctggtcagggaagcttcctggaggaggaattgcatggctaagccctgatatacaagttggaggtaggcaggtgagttgggcactatagggaggggagggagcaagtgcaaaggcatgggggaggagcctggcatgaggcaggtactaagatgccattagaactgaaaaggacatggctgtgtgaagaagtgccacaagacttggctggaaaggaagacagaagcaaatcacaaagggccttttatgacagactggagagttgtgatttattttgaagttggtggaaaaccatgaggtggttttaaacagagaatgaacatggtcagatacttgtgctctggcaatagtggagcatggatggaggtggaaaagtccagaggcagtgagcctttggggtgctctgcgggcctggcaggaagtggcgctggcctgagtgagggctgtggcaggatggatggatgatatgaggggagagattcaggaagcactgtggcttgggggaagagctggtggacttggctgtggatggcagaatttacctgaatttctggcctgggtgaatgggggagtgaaggtgactgtcactagtgtggggacccagggaagaggaacaggcttgtcgggcaaagttggtagattgccttttggatatgttgactttgagggccagcagttagatgtctgtatctggatttgggctggtattagatttgggagtcctcatgtgtccaaaaaccataagaagacaagcggatgcaagatggccatgagaagagaggaggtccacatcttgcggttgggggcaattccaggggagaggctggaggggagagggaggggcaggagggagagagactccaggggcgggtacagcctgcctctgaggggagggaggatgagggtaggaacttgctctctgctttggacatcagagacccagggcagattcaattttagtggcatcgtcagagaaggtgatgatggaccaggtgagtcgagtgggaagtgaggaagtggaagcagtaggtgtagattccattcttaatatacttggccacgaaagggagaggagagagcagtcgttaaatggggccaagggccgaaggaagctgtctgtgtgtttggttgaaaggataggggatatgaagccctctgtacctctctgacacatcacccagtcttccctgggttatagcgacacgagtacatgtcccatctttctgcagagacaggccaggaccaagcctccatcaactgcatccagacataggctctgggcaggaatgtcccagagtcgccctgtatcgtgatggggtgaccaatcaaggtggatgctcaagcgcatgcacttaaattcatggaagaactggcgtcacaggatccccatgctcaaatgctgctgccttctggtggagtcaattcccatggggcagctcctcagagggaaggccacactgacacctacccatgaacaagacagggaaggaagcaaattcttactgcagtctctgctcaaattgcacaagtcagaatttcgttgtgttgttctccaggttactttttatatacgactatttcatctgcttgattagattaaatgttccttctaggcagagcccatgtggtgctcctctgttttcatcacaaaatcagcaccaaggaaatacttcatagaaaaatatcatcttgggtttcaaaaaacactggaattctcaccagatttgtccccctcatccagcaagaagccctgttgacagcgtcctcctcagaaattggcccagcatctgcttgaatgagagccttcaggcaaagagcccgagtgcctgagcttttcttacctctttcttctttaatagataggtttctcactacaagtactatatactcatcgtcgatttgaaaatacagacaagcattgaaaaaaacttcaaaggtttttctaattatatcacctagaaataaattctgagaaaatggattgatatcttcctctatcttcctgatatcttcctacacacactcatatttgtacacacataagaatactgttagattactttgaaaacaacactatgtcacaatcatctttttatgtcaataagtatttctataacaaaatttttaatagctgcaataatgttctattgcatggaggtaccatagttatttagctagtcttctatttcttctattcgggacatttgagttatttacaatgatctaatatttaagcgatactttaattaacatattcaaatatgtgttgttgctcccatttttatttcccaaggttaaagtcaccagaactaagttaaagggtttttaaaaggtttgatatatactgtcattttccagaaaacacgtgccaatctgtaccagtttatgagattacccttttgtttgcacagctgcactgggcactatcaggtatcatagtttttgccaacatgataggtcatacatggttctctactttaattataattcttaactcattgtaacttaaaattttataattgtattagtctgttttcatgctgataaagacatacctgagactgggcaatttccaaaataaagagttttattggacttatagttccacatgggtggggaggcctcataatcatggcggaaggtgaaaggcacatctcacatggtggcagacaggagaaaaacttgtgcagggaaactcctctttttaaaactatcagatcttgtgagacttactcactatcacgagaacagcatgggaaagacctgctcccatgactcaattacctcccactgggtccttttcacaacacgtgggaattcaagatgagatttgagtggggacacagccaaaccatatcaataattatgctttttaatcattttcatttcttcttttgtgaactgactgcttgtataatttactcagttgtatattggggtggtcatattgtctttcctaatttggaaagaactctttatggcttctattgtgttatacttagaaggaccttctccatttcaaaatcacaaaaacatttactgatatttatttatttgtttatttgcattataactattcagcccattaaggatttattttgttgagtattatgagaagaaactccaaatatttttttctccaacattgcttacacttttcccaggaccacttattggatactctatccttttcctgatgatttaaatttgcacttggaccacataccactcactatattgttggctctgtttctgggtttttcttctgtttccttcatctatccctccttactggtgtcagctctgcaccatctcaacttttatgactttgtaacacatcctttatctatggcagtacaaatctcctcttatttctgggatagaaaccgacctggattactctggtcttaactcagaacacgtaggactttaatcgttgaacaaatgaacccttaatagtggctacaccattagaatgtcctgaattttacttagtttttaaaataaaatatcttcagacctgcacatttcttacgaagaaggttagagaatggtctcagttatttagagccaggttggcagcttctcagaagagatcaggttgtaaatccactggcccttcccagcatgacatgcatgatgaagtgtagtggtgaatgttgttggtctgccttggacctcatggcccccttacagattctttcttgggcagcagtgttaggaaaaaaaaaaaaaggttctgaaaagggtgcattgctaggaatggctcaagagtctgggaatgctctaacgagagacattgaaacacagactcatgcagaagaagctgagctccctcacccacactcctcctcccttcagtctgcttagggagaggaggcagggcagtaatggtgtttgaggaggcaagtggctgatagtcctgcctgaaatttcaactgggtagatacgttaagaaaaacaaacaaaacttgaattctaaagcttctgcaggctttgaattgctgagagaggacaagttagacggtctttgggttggctggggagcttattgtattttgggataggaaaaaatagggcagaagcctaatttaggtggagagtgaaaatgctaaattgatctgtgtggggaaaaaatataaagagtacaggtaacaagaaaaagggaaaaagataccatattaagcatgacagaaagaggggcgagaaagagtgcgagtgcacctgagccccatggttggaagagggacttgcaaaaggacacagccagcaagacatttcctgcagggatggctgctcaatgcattgtaaagaacagtggtatctgagtgcgaattcaagaaaacacaattttgtcctaggctgtaattccccgattcagctcctcaaatctttagtaaaatatgcctcatccaaaaattccatggtagtggggctttgaggaaataaaggagagtgactctttcccagagtggagacaagtgggcaggccagggctggtggcgaccacaaagctcctagtggtaagttaaggttcttacttagggtggagaagaggatgtggtggagagggagaccctgcctcaggcagcagggagacagaaagggacctcctgaatctgcattatgctccctggtcagcctttccagcctggcaagatgatatcagtcatctgaagattcctggaatctctgaggatgttctccaagtcctccggccccagatacggaaatgtgaggcaggtaactgccaccaggtggcgccaatctgcagccggcacctggaccaaccagtattcattaggcatttcagtaacctagcaagaaagcagcatgcattttatgaggtcgaattcattacacaccacacagtgcccacctcccaacccctacattccttaccatgtcatggtgcagttttccagtatgtggggtgttttgttttaaaccactgtagcatgagttttgcaaatccccttggaatactgcaaccctattgaggacaaggctgcattttatatgtgacatttgctctgagtatcagtgggtactgatacatgttttgctgatataatccacccactctcaaaccctctagatgggtcttaattctattgtgttgtgctctgcttgaggttgagttagctgagtatcgcatcgccgcagtggaaggctttttgctgggtgggtaggcagggacagatctgggatgagcttctctcgatgcagcagctggaatgaacactgggctggggttgggggttgtgggagacggattggatacatgcagaagtgaagcttgtactttatccttctgtcacgcactccaaatcagcttatttttggtgggacattgtttagaaactgcttcaattggtgccaacggatatgagtaaacatttcttgatatacgtaagttacaccataaatgtgggtgttggttggtattttacacttcctctcatctctctctggagtttgaaaaagcacttaaaataatcaaaacagttttagtcccaatagcctgtgactaatagccatccatgtctctaagtctggactaagcatccagactcacagccctgatgctaagtgcccattctctttgctgtgccctgaaaatatgtactctcaacaagacaaatcttaatacagccactactaacaactggccaggaaccttttcttctgaggaaatttattatcaagtgtaatacaatgtaaatagctatcggcttagaagatgtagaaatttcatattttctacctgcagtagtttcattgtaaaggtgtttctggagagtggattccacttcatctcattacctctgggactttgggtaaaagagagatattgctaacctcctttcaacaggaaaaattaaggtgtaaggaaggtaattgccttgttcaagtcactcagggttgaaatgggaatagaaaacagatcagtccttgtctcatttcagccctgtgcatttctttctctttctgctcagatgagctaagaagaagaatggataaatgtcactcagagcggggaaaccacagtttttcaagaatgaacaaatacgtcaagcacaaaaattatctgcagcattttataatggcagataatttattgaaaaattgtgtagcttaaaaaagcaggcccaggattgaaattcatctagacgagtgactggaatgcggccaagtcttcgattccatttcatgtttggattcattcttgtatttccacagcctgttcttgtcttgaaccctgagcccagagagactctcggttaactgaaatatgtgggaaagacaaacaccctactttcttttcttagccaaaagtttcccagcatagacaatagaccattatgccatgaggcacatagactgccagtctacagtttccattaacaaattgggcaatgcaatttatgtgtctcacaagaaattgtcaaggatactacattaatcaatttgaagtctgttgtgaattgtgtgtgagaggacaaacatttaatgtgggagtgatgacagatttttctacctccccaaggcatccaaagagaatctaataatttctggactatcttttatgcaacctcctcgtcttacaaaaaaaaggtctttattgctggaagaaaagctaagctaatctatgcaattgagacagaaagtctatgcagattggatgagggagaggaggttttgaatggagagggtccgaggggagcagtgggagattatgagagcaggaggttagctaagacagggacttttttttgataggtattgtggtggacagttgtttggggcactttttaatggaatttctattttatcacttttgctaattaagccaggcttcctcaacttcacagttcttagatgctgaatcatgcagatttaggctttataaaggcttcatatatattgttagcaaagtcacctgttcaggtttggggccagccgtgtgttgaggtagcatcttcagttatgggcgaggaacatgggaagaggaggctgcatagttgctgctaggccccatgggttcagctacccaatttttcatgaaccttctattttgtactaggtgctgaggatataatggtgaatagaaacgacatggtccctgcttttgagatgcttgaagtatagtggggaagacagataataaacagatacatcagcaaataaatataaaatcataaatgttgctaagtgaatagaggagccaaacaaggggagtggtagagagtaccaggggtgtccacacaaaggactctgttaaggtaatgtttaacagagacctgaagttcaaagcagcgacgtgaagggtgcagtggtgggtgccccatgcagagacaaaagcaggcacagaggccctaaggtccaaatgtgctgggcacattggagaagctaacagaatgcctctgtggcttgagtggaggggttgaggggtgagggccatgagatgtggtgggggccacagcctctagggtccttaggccatgctgtcaggagctgggcctgcaaagtgccaagtaaagtcactgaaggggttaggcagggtgggatatgatctggctttgatttggttagacatgcaagcctgggccccggtaagaggctgcactttcatctgggcaagatataatgaagactgggactggaagggtgtatcagtcagggttctctgcagaaacagagccaataggagatatctatgtctatgtctctaagtagctatttatctatctattgagatttatttattttaagaacttggcttacacaactgtgggggttggcaagtttaacatttgcaaggcaggctggtaggctgggaactcaggtaagagttgatgtggtcttgaggcagaattcctttctttctagaaaatctcagcatttgcccttaaagccttcaactgattgcatgagggtccctcacatcatggagggtaagctgccttagttaaagccaactctttgtaaatgttaatcgcgtttacagataccttcacagcaacatatggactagggtttaccaagtagccttgcccaggtgacacgcaaaattaaccatcataagggcacagctggatggaaagagctgggaaaacccagggcatgatttggaagcattctagtaacaataataataactaccactactaccaccataaacatattaatagctgacactgatacagtgtttcctatatgccaggctctcttttaaattctttacatatataacctcattcagttctcccaacagcaatctctgtgttacagatagtaaaacttaggtacaaacattgcagagtgcttacagacttcccttagcataactcgggacaccactcacagagactattgggtaaatagcacccccttgagttgtgcaatccacttgaccctgagagacagtttaagtaactggcccaagaattctccattgtagagattagtgttgtccaggatggaaagaattataaaactgtatgggaaggaatgccatcagtatggcatacatactttttaaaattatatgtacatgatactgtttggctgtgtccccacccaaatctcattttgaattgtagctcccataattcccacttgtcatggagggtacctggtggaaggtaattgaatcatgggggtgagtctttcctgtgctgttctcgtgaaagtgaataagtctcacgagatgtgatggttttataagagggggttcccctgcaccagctctcttgtctgccaccatgtaagatgtgactttgccactcctttgccttccgccatgattgtgaggacttcccagccatgtggaactgtaagtccattaaacatctttcatctataaattacgcagtcttgggtatgtctttattagcagtgtgagaacagactaatacagtatatacatatatatgtatatgtatatctatatctatatatgtatatatttatttattaatatagtgagttttaaaaaatgacaattttattttagaataatttagatttacagaaaagttgcaaagataaaacagagtttcacagtggctattccacagccagtgcccccttttactaacatgttattagtgtagtacatttgtcacaatttatgaactaatattggcatagtattaactgaaagtccacactttactgagatatccttagtttttctctaattgtttttctgctccaagatctcacattaagtttacttgccatgtctccttaaacccctttgggctgtgacagtttctcagactttccttgtttttgataacattgactgttttgaggagtattggtcagatattttgtggacagtcccttatctggaatttgtctgatgtttttctcatgattagaatggggttatggctttttgggaggaagtgccattcttatcacatcatatcaagggtacatgctattattattatttatcactgttgcttgatctccaggctgagacagcattgtcaggtttctccactgtgaagacactcttttttctttctttccatactctaatctttggaagcaagacaccatgtgctgcccacattcacaggatgaggagtcatgctcctcccttgaagacagatatctgtatgaaatttttggaattatcctgtgtgggaggtttgtctattctatctcatttattatttattcattcattcctttatatcagtatggactcatgaaatttattatatatttggcattataattcaatattatgtcatttattttgctctaattgcttcaactttggacattagaagcccattcaattgacctacccccaacattgtatgtatgtgtgtgtgtgtatgtgtgtgtgtgtgtgtgtatgtgtgtgtgtgtgtgttttgagcacttcttttctggaaatacaaggtacttcaggctcatgtaagtgcactgcttctgtcatagaatcagccattactctaaggagccctggttccttttattggagaataaaaaccaccatctagatgctgggtggtacagagccttgttaacttttctaaatgaaatcatgttgattatgccatttcttcccacatgtatccttcagagtgagtaaaattatcctattttacataagaagaaactaaggaaatggcctccaaaggtcacacagcagacctcgaaccagaccctaagcctcatggcaacaagcctcaagtttcttctagccacgcttttattttctgcattgtttctcctgtgtgtctctgggtaaatttcatgggttcaagaatttttactcatttaattctcataacaaccagagaagacatgtactgctatatccttagctctactttgcaggtaaggaagctgagatacagacaggtaagcaggctatgcatagccatgcatctggtgagtggcagaggtcagacatggacccagaccctccaattccatgggctccatgtcctagtcctctatggcaggggccgcaaactatggccccagttcaaagcaagtcgccatctgtttttatatggcttgcaaattaagaatggtttttatatttttaaatgaccagggaaaaaaaaacaaagaagaatattgttttatggcatgtaaaaattacaaaattcaagtgtcaatatctgtaaataaaatgtccttggaacacagtcatgcccgttcacactaagtattgtctgtggctgttttcgtgctctggtggctgagtggagtagctgtggaagagactgtaggacctgccaagcatcaaatatctactacttggcctcttagaaaaatgtgttgatccctgctgtaagggaaaaatctaaagtcatcctcttaaaactgtaaagggaaggggctgaattacaatcattatagaggaaagcagcctaggctgggcccaactcttgccaatgctgtgccttcactggccttatttaggctattgggatgccctcccttctctggcaccaatccaaatcttatccttcttcaaggtccatcttgtgctgctgggagattctctgaaccagtatggtcttcctaatcccttcccgctctcatatcccagagtattcaacatcgacttacattttcattaactgatgccttgtgcagttcttcatttcgtgcacattagctttacttccaagtgctctgcaggctcctataaaccagagacctcacatatctttcttctccactccctatgttatcaaccacagattaagttttctaaaaccctgctctgatcattgatacaaatgaccttcctgtccaggcttccaattgcctatgaaattaagcacaaactccttagcacgacagttaaaactctccataatgtaattcccaaccttaattcttactacttagtgcccagattaatgcttggcatagagtgcctgctccatcaatgctccctcctgctctccctctctttgctatctctcatgcccttgccaaactggaagagagaactgagaacaaaccactgggtttgacaattatcaggtcactcatgagcaatttcagtgtcgggatggagacaaaagccagatagcaggaactgaaggagtacgtacgtcatgaaaaaaataactgcagcaagcgtagcatagatgtttgtttgtgctaaggagggactggaggagtggcagccaggaggccagtgtttagtctagggggagcacagagtggatttgtgggtgaaagacaaggagtcaatggcaccgtgaagtaggagttagttagggtcagctcaggaggagcaggaacagggatccagggcacagagggagagaagggaaggaaagaaagaaaggatccagtttctgtcttctcagtgagtctgatgtgagtcgtctgccaggtcaaggatgcaggacgggattagcgatctgagaccagccacaagaaggcagctgatggcatcagtaagagaagtgctgaaagatcgccaagtatcataatcaatatggccacaactagcctggtttcccgtcttttgctggcattccttggagacccagatgtgagagggaagaaaatataaggaaaatatagggcagaaaagttgaggttggggatcgtccatgagagcatgaaaagcccaactctaaccctaaccctaaccctaagcctaacccaaactgggcattggcattggccagattagtagggtcgcagatcacaatcagatatggcacctggagggttctttggttgattccagggcttcctggcatcagactctgatagcctgaagggcatgtgcactccactccacagtgaggatctgagtgtcaggaggatggatatgcttgccctgagggcacccagctctgctgccttgcacagcgcctggcacacatctggtgtcctggaggtgacttaggaggatgagaccaacttcaggacttttttcctcaaatcttcaaggtctatggttccaagttttctgcgttttatggaaaatgtttaaacaaaatttgaggattgatgtagatttttttcagtctcttattctgccagataaaaacattaaaaaactaagctgagctaaactaaactaaactagactaaacaactattgtcatcatcaccacattcattaaatactatctcaacaccagaaaacaaataatctcagcaaaaaagtcagatttttaaatatagaaacctctctatataagaggaaaacctcactactcacaggaatagggacccggtgtttggaaacccctgagaatctatagtcaccttccagaagagctacagcacagctgacttcatttccacctactcacaatcaccctgattggagctttaggtgttcctaaacccagcagtctaatttttacagagaagctccattttaaagacagctcccacatcttttgtgtgtggacactctcagtggaattctcacacagtcactttatttctaagaggagaagaatggagtagtaggtggtgactacctggtgaccagggcttagagccaacttctttggactgacatcccccttcaagggagtaagtgtgtgtggcaaggggaccatacatgaggttggaattggctggtaaggtaaggaaaggcagcaactggtttgagccctgtaactaagtggcaccaaggccaaagagggaaagaaaacaagagggaataaaggaagagaaggtgaaggtcaggatttccttggctggtgtcaggtgtcgggtgggcacccactgaggctggtctggcaggagggggcagtgggtctggggggaggtgggagctgacaggaggctcctctgtctggagaccaggcacagagaagaaaatcctcctgccatttgccgggaaactcactcactcttctggcctgtgatgaggccctgggcagattctccttcctatagcctcacataggaatgccacttctcaccagaagggctgtttctgctggatagggtgaggcattacttttagacatttacagaatatgttctcctcagcacagctgtgaggccctttcctactcaagggctgtgaacctgaaggcaactcctcaacccctgaaatagaactgtggtggtacctacccctctcattctgtgcattgcccaaatcaaaaatgtatcttgatattatatagtatggttatgcctgagataaagcatacataccagaatttatgtttctacttatttttaaaaaatacttgttatgtaatactatttacgaaatggaaatgaaaaatcaaaatattttcacaagcggggcaagctgtaacctgtgctcctggatgccagctctactcaccaggagcatcaagctcattagcagggtgagaaactgaggcaagtggcaagtgttggctgtgtagttgtgacttgttgcaaaggagagaaattgacaacagggattcctgtcactttaattccctgaaacttcagcctctagcaagagctctgttaaacctgcttttagacataggcatctatctggagcccctgggtcttgtagggaatgcagagctcagatttcatgtccgtataacatggccctacagcatgtggctcattctcccaggaagattggccctagagcttgttgtgtcagctttgaaatgtcttgttaagatgtcacatttccccagactggggaaatagaaactttaagaagagcagctagtgaggaatacactataataaaaagtaatatgacccagatttttcttttaaagtgagaaaactctttcactcaccttagccattaaggaatggcccctgaaggcagggattttttttttcttccaggcaagaaggtggcttcagatcatagtctataggctgccttctgccatggagaaggcagttgtgtttgggttgtgtgtgtgcatgaggattaggctctgtgcatggaataaagcattttagtactaacagggtcagggaacatctatgtgtgtagcgtgggttggtaaccagctggtcttgatttacctggggttttcccagtttcaaaactaaaagccccacatctagggaaacccctcagttccaggaaaaccaggatggttggtcactttagatgtggaagcactgagaacctgctgtcattttccctcactggcatgtgacagggcttatcatccactatttaagatctattcttttgagtccaggaattgtcccatgttaaaatgcaggcagctttaagaagagtgacccattaaaccattaaagctgagaagcggcattctacacagctgattattccctcctgcttaactgtctctttcctcagggatatacagattaagaccacaataggatagcattttacatttactagctagggaagaaataaaaagtctgacaataccaggtgttggtatggacatgctacaacaggaactcttatttactgctggtgggtgtgtaaattcgtgcacctactttggaaaacaattatcttacaaagttgaacatgtgcaaacccaaatgaatttcactttaaaacatatgtcggagagaagctcttgtacttgggcctcaggaatcatatgaagagagggattctatgacctaataatgctttagttcacaagatgggtgttaggattacttgtttcaaattattattatgtcccatacttacatatatgctatatacattcatttgtaaaaataaaaatatatgataactattttaggaaaataaggcagaataaatcaaaatatgtcaatgttcacaataaatgtaaaaactaaattcatcagttaaaggacagggatgataagaatgtgtttaaacagcaacaataacaacaagaacaaattcagctaattgctgtttgttagagacatatgtgaaatgtaaagactcagattaaaagtaaaaggacagaagaagatattttaagctagaagtaaatatgttaacatcagacaaatgacgttaaagcaaaaataggaatatataatcttaatgtccaacattaggaattcatagtttttacaaaatcaccataaagctataacttgtttgaatctacataacatgtcttcagtgtgtataaagcaaatcccaacagaattaatagaagaattggacaaattcacaaccatagtgggagatttaaacacagcatatgaatggcaggtttgtgctttgatctgcctttgctgcttattctgtcctttcttattttctactggactttaagcaagtctcttccttctgttagaccttagtttcttgcacctgaaaagagggaattggaccagatgggtgaggactccatgaaataaccatactcccatgccagtcagtgcctggaaaaagccttgtcacatgatggatgcttctgagaccagtggcagctggcgctgtttactcagcatgtcccaggagaatccatcacctgttgtctttcctgaaaacgccactctcaaatcccccttactgattgcaggcagctttgcacacacagaagcttataaacctttttgtcagctcaagggccaacagagtgaaaactcatagacccagcttcttggagctacatgtttggtttgtctctcagagtcaattaggaggtgagagaggaagtcagtatagactgattccactggcgggctgacactaacaggacatgcatgcttggaaacatggaaggggccatctgtgaaagcttggagtacagcttccctaaatggtaatttcaaacgcagcataaaaagatgaactgggaaatgctagtttggtaacatggagcccgagaccaggagtcaggagcctggtgctggttttctggacctgacaatcactggggcaacgttagccaaggtgctgcttgtctctacatctcttcctcatttctgaagtgatgggattgtgttctaacttctgaggccttcgcatcttcggtaaggcctgagaactctaagttttggtaggatatctcttttgttaattgacttttttattcagtaggaagggggaagtgagctaaaatttaccaggtgcctactagcttccgctttacacaggtaatttcatgtaattttcaccacacatctattattattattatcatttgagacagagtttcgctcttgttgcccaggctggagtgcaatggctcgatcttggctcaccgtaacttctgccttctgggttcaagcgaatctcctgcttcagcctcctgagtagcttggattacaggcatgtgccaccatgcctggctaattttgtatttttagtagagatggggtttctccatgttggtcaggctggtctcgaattcctgacctcaggtgacccacccaccttggcctcccaaagtgctgggattacaggcgtgagccaccgcacccggcctattattttaattttactgatgagaacagaggttcagagagagaatactttggacagtggtgatttgaactcaggtcttttaaaactaaggactgcactgtttgtactataaccaccttctccagtgggtaggacacctccagtaagaagttagatggacctactgtgaattttcattcctgtaaggtagactcttccagaagaagctgagaggagaggttgttggtaaaatccacaagtatctgataattgatgtgggaacaacacaatacacaaacatcctggtaaatgatgcttagcaggctatcctgaggcagaagcctgcaggtaacaggtcagtgtctgcattcattaattcctgtgtccatttattgaatttttttggtgtttactgtggatcaggcctgagatgctggggtaacagtgatgaacaacacagaccagccctcctgtcttgtacttcaaatctactgagaatttaggggcatccttgggagtatggagctgtacccatccccagataagaggtataagggaaggcccccaggaacataacccattaatgatcttttcctctttcctttctcctccaatttcccaattttagtcagtccaagctctgtgttcatctcattttcttcccataatcaaacttaaatcagtgagctcaagttggaaagctcattcatatctattgcattacctcttctggagaatctgcattttaacctaggactcctgagattgaattaaccacttctctactggcgtaactgctattactgcagcaggacggtgtttcaaatcaagagtgagggggtgttccccagatcaccgaggtaggtctctactaccatcatggaggtctagaacagtggcacagagcttacctgaaagagctgtgaagtgtgacgattttgactacaatacttagctgaattatgagcctagttcagtgcccccattcagattctatttgggctcttgtctcttttgaacttggagttttgcatgttttttttttttaagttgcatgaccttgagtgatttctaaactctctgaatctcaacttatgtatctgtagagaagagattatagccctcctcacaggaggttgtgaggatcaaatgagatgattcatttaaagagcctagcacagtacctgcctcatggtaggagctagataaaaacttaaaattatttaaaataataagagtttaatttctattagtctctaccttgtctctattttattatttttttctttgtattaagatactcttcttctagccaatatatccaatggcatctttgtttgctctcccatgttccacctgaacctactccagtcacatcatttgtgccatttccaacatcatgggggtagaacaaacacgaaactgtgcccttgtaggagtgtattcagggaaaccaagaattttctttgcatcagaagagcaaatagtaattctaagtggttttcaaacgatggatattccaggtttatttattccttttctgataatcattctgtatgcaaaatgctgagcaccatgatccatcttttgtaggttctgggtgaagagagctttcgttgctttagacccccttttcctactcactctccatctagtcacaaatcctgaagagtctcagtattttaagggaaaaatatgacaaaatattctcaagttcaggtaaagtaaacatacactctggcaaacacatcgaaacatcaaaatcctgtctgtgcttgaggtcctaccagtgctggggagctcaccacctcaccaggcagcctataccattaatttccaggagtaattattcctgaagttgcctttatatagaagccacatgatataccttcacatcccttccattcatttgtcctaattttgctctctggagcaacccaaagtaagtcccatgcctcttccatgtgacagcttttcactctctctttcatatacttcccttcctgtccaacacatggccgctgctgtagggttgctatcattttgaatgagctactataataagtttcctgagcatgtctctctgtgtgtagtctttctcccttccaacccatcttccccattcgtgccagatttctattccccaaacccagttactttctactggttaaagtgttaaatttggcacttgggccagtgctgctgcctgtggtgtcctccctgctgtccactggtagccccaccatgcccagtctgtctttcttgatttccctcctaatgtaaccctacaccagtggtacccagtgctatctccaggcaccatggacaatttgttgccaaaaataccttgtgattttctgcctccttgatttcacttgttccatatttattctttctcttgaaggttcccccacttcaccctctgtgttcaaactggattcatttacatctcaggaaaagtccaaactgtgcatctaaacctaatgcctttttttttttttttttttttggtctcactctggaatgagtcatttccattcatcctctgagagattgctctgcagggggttaaaccagtcgtaacaatgttctggagtattgatcccatgttggtctttggagttatctggggaagaaagaaagactgcaggtggagaaaccaccatactgcctcagcagctgtgtcactctgggcaggttgctgcatcacaaggtacagagaagtttggcagaaactaattttgaaataattaagttgttctgtccacagatcatagcactagaagcagttaccctccaatcttgcaaaaggttattatatatctattacttatacttcgagatagtaagattgagataaggttaattgttactgaaattagaaatctaaatgcaactagaactttctaattaagttggtgtaaatatttaaaagagtataatgcacatttcaaaggggtgaatgctaaacgtccctttgaaatgtgctgaggaagagaaatgcagtgctcagtcactccgtcctggaaaaaggttggctcttcaagaggcagaactcacacaaagcacatgcatgacaacacacatgcacacacacatgcaggcatacacacacaaccatcatctcttcacttgagcatctatcgccattggtatgctcaaaaatagctatttatctggattttttattcccacaatcactgtcccattgggtcagttatagttagattttatagtcttcctagatcagaactttggaaacatattgaattgcccattatataagagcattattaactggcttaggaacctgatgtctagagccatcacttggtttagggggaaatcacctaactacagaggacagaagatcagagccttcattcaagctcttctattcaccaatctcatgagcttaaataagtcttttatcctttcctatttccaggcagggttagcagatccattgcctacttcccaggcctgttgtgaggatatatagaaataactggtgtgaaaatacttaggaaagttaaaaaatgcacccaaatattattgttgttgatgtaattattactcagttattaccctattagctgatagattagcacatacaaaagaaatacttcttaaaccatctccacctgggatggggataattggaaggaaggaagccgtgggtagaaattagataaggaaatagaaaagacagaatgagaatggatgaatgagtcaggaagagtgagggaaggattatttttacaaaaccaactgggaaattgctataattccaggccctatggcagactgctcgagagaaaaatgggcatgccaatcaatgcatcagcctctcaattcaccacaccagaggtgctaggaggaatacaaaagaagagccaggcctgccctgggggaaatcactttgaatatagaaacacgatgtaaattagtaaacaaaacaagactgtataataattaacaaaaaattgtataacgggcgtgtattagtgctgccaggcctacctttatatgaaggcaagaggggttcctgtccttggtcctgtgatacaggggtcccacgaaggctcttccatgaccagcccaccaccatatggtgaaaaatctgcaggaccaagaaccctctaccctcattatgctgttagacaggggatgctgaaattccctggagcctcttctagggcctgtgtgagcctcttccattggattagtctctccaagggtggaccatcctgctctttttgccttaggggtagccaaagggtgaaaataacctggatgtagagattggggtgtcacatgtataagacccctctaggttgggggcagagtcagggaggggtggaaaagaaagtgggccaggatgagagctatgggctgcattgtcctgcaagggcaagtttccacaaataattccaaggagtccaggggttcaaatctggcctccaggtccacattaatgcatgtttttcaaggtaagggatagagattttaattcatcatttattagcatgacctataacttaaatatttagagatgatatgcagactctgctcttgtttctgacttgcaaatgttagttataggtctgagtgctacagtagcttgtagaagggagaaaccaacatttcttttttttttttttaaatatatatatgtattttttattatactttaaattctagggtacatgtgcacaacatgcaggtttgttacatatgtatacatgtgctatgttggtgtgctgcacccattaactcgtcatttacattaggtatatctcctaatgttatccctccccactccccgcaccccacaacaggctctggggtatgatgtttcccttcctgtgtccaagtgttctcattgttcaattcccatctatgagtgagaacatgcagtgtttggttttttgtccttgtgatagtttgctgagagtgatggtttccagcttcctccatgtccctacaaaggacatgaactcatccttttttatggctgcatagtattccatggtgtatatgtgccacattttcttaatccagtctatcatttatggacatttgggttggttggttccaagtctttgctattgtgagtagtgccacaataaacatacgtgtgcatgtgtctttatagcagcatgatttatattcctttgggtatatacccagtaatgggatggctgggtcaaatggtatttccagttctagatccctgaggaatcgccacactgtcttccacaatggttgaactagtttacagtcccaccaacagtgtaaaagtgttcctatttctccacatcctctccagcacctgttgtctcctgactttttaatgattgccattctaactggtgtgagatgatatctcattgtggttttgatttgcatttctctgatggccagtgatggtgagcattttttcatgtgtcttttggctgcataaatgtcttcttttgagaagtgtcttttcatatccttcatgcactttttgatggggttgtttgtttttttcttgtaaatttgtttgagttcattgtagattctggatattagccctttgtcagatgagtagattgcaaaaattttctcccattctgtaggttgcctattcactctgatggtagtttcttttgctgtgcagaagctctttagtttaattagatcccatttgtcaattttggcttttgttgccattgcttttggtgttttagtcatgaagtccttgcccatgcctatgtcctgaatggtattgcctaggttttcttctagggtttttatggttttaggtctaacatttaagtctttaatccatcgtgaattaatttttgtataaggtgtaaggaagggatccggtttcagttttctacatatggctagctagttttcccagcaccatttgttaaatagggaatccttttcccatttcttgtttttgtcaggtttgtcaaagatcagatggttgtagatgtgtggtattatttctgagggctgtgttctgttccattgatctatatctctgttttggtaccagtaccatgctgttttggttactgtagccttgtagtatagtttgaagtcaggtagcgtgatgcctccagctttgttcttttggcttaggattgacttggcaatgtgggctcttttttggttccatatgaactttagagtagttttttccaattctgtgaagaaagtcattggtagcttgatgggaatggcattgaatctataaattaccttgggcagtatggccattttcgtgatattgattcttcctatccatgagcatggaatgttcttccatttgtttgtatcctcttttatttccttgagcagtggtttgtagttctccttgaagaggtccttcacttcccttgtaagttggattcctaggtattttattctctttgaagcaattgtgaatgggaattcactcatgatttggctctctgtttgtctgttattggtgtataagaatgcttgtgatttttgcacattgattttgcatcctgagactttgctgaagttgcttatcagcttaaggagattttgggctgagaccatggggttttctagatatacaatcatgtcatctgcaaacagggacaatttgacttcctcttttcctaattgaataccctttatttctttctcctgcctgattgccctggccagaacttccaacactatgttgaataggagtggtgagagagggcatccctgtcttgtgccagttttcaaagggaatgcttccagtttttgcccattcagtatgctattggctgtgggtttgtcataaatagctcttattattttgagatatgtcccatcaatacctaatttattgagagtttttagcatgaagggctgttgaattttgttgaaggccttttctgcatctattgagataatcatgtggtttttgtcattggttctgtttatatgctggattacatttattgatttgcatctattgaaccagccttgcatcccagggatgaagcccacttgatcgtggtggataagctttttgatgtgctgctggattcggtttgccagtattttattgaggattttcgcatcaatgttcatcagggatattggtctaaaattctcttttttggttgtgtctcttccaggctttggtatcaggatgatgttggcctcataaaatgagttagggaggattccctctttttctattgtttggaatagtttcagaaggaatggtaccagctcctccttgtacctctggtagaattcggctgtgagtccgtctggtcctggactttttttggttggtaagctattaattattgccttaatttcagagcctgttattggtctattcagagattcaacttcttcctggtttagtcttgggagggtgtatgtgtcgaggaatttatccatttcttctagattttctagtttatttgtgtagaggtgtttatagtattctctgatggtagtttgtatttctgtgggattggtggtgatatcccctttatcattttttaattagtctatttgattcttctctcttttcttttttattagtcttgctagtggtctatcagttttgtcaatcttttcagaaaattagctcctggattcattgattatttgaagatttttttatgtctctatctccttcagttccgctctgatcttagttatttcttgccttctgctagcttttgaatgtgtttgctcttgcttctctagttcttttaattgtgatgttatggtgtcaattttagatctttcctgctttctcttgtgggcatttagtgctataaatttccctctacacactgctttaaatgtgtcccagagattctggtatgttgtgtctttgttctcgttgggagaaaccaacatttcttaagccgatgcatcaccttgggcagttgctgcatcacaaggtccaaagaagtttgcctgtcagaagctgattttatcccccttactccaaccaatcaacacccccaattttccagccccttaccctccatgatctcctaaaaaacccagcccagaactccttggggagataaatttgaggatcttctcccatctcctcacttggtgtcctgcaatcatttctctttctctgccacttctgtctcagtggaattggtctgttactgcgcaatgggcatataaacccattggtcctagcgcaatcgcactggaggaagtagttactctccaatcttgcaaaagattgttgcatgtttattacttatacttcagaatattaagattgggagaaagttaattcttactgaaattaacggcaaatatcatggaggatttgaggaggtgggatctgacttttgccttgagctagctgttgggttgggaaggaattccaaggcatgtgaatgactgagcaatgtctgggagataatgagggtaataacggtgacctggctggagtcagtcacttttgattccttccagtcccaaccactctccctactcttccctggggttaaattcccacccttttttcatatcttattgaagctctactcacttgttagaacattttcagatttcctcattccataaactcattctctttctctgatcccctctggaattctttatgtacaccactagtatgcaccagtatttttagagaagctattgtatgtgacaccgtagattagttggcactacccagtatagaatttaattatgaaagtaatagtttctggagtattagtttcatgttcttagaagttcccagagatcaagagctcttcagttaaacccaaagtgactatgaaactgggctgtaacaaggtcatcttaacagttctgtgttgtttgggttgaggagagagaaaatggaagaggaggaacaattattggtctcctcaaacttttccaggaaagttgcttctcacagcagaggaactgggaatgtgtatcctctggggagactgagagcatagccctaggctatgcatgtcaagtctagacatttatataaaatctcttgttttatctaaaaacttcatgcagattttatattctagtccatgatatgtttttgcatgtcttaaaacagaattttaaattacttatcactgagataagacaactgtcttgtaagatttatcatgcctgttttataaagtgcaaattattctcaggtccaagtgcagtacttggcacacagtggacactcaataaatatttactgactgactgactgactgaatgaatgaaccaggttggggagtctcatacacccagtccattgtactatatctccaagaggaagcaagcctgattttgtgaaatgggggattatgatgctatttcaatggtccatatgtgaggaaaagggcctggtcaaggttttggcagtgtaggggaaggatggatatgagagacacttcaaaggaataataaaagggactaaattattgcaaatggaatccaaaaataaggatgataatcggaaatggggaagtttcaaaagagagagaatgtttaattcaactttggcctctgagtttgtgatgacagtgtcagattcaggtactcttaggtcatatttcctagcagtggggattttgagagtcattgtcaatgtgacaatgactttcacctttcaataaaatgtgaaatcttcaatctggtaagagaaatcatcactgtttagacccatcttgcccaatatggtagccacatgtggccaatgagccttgaaatgtggctggtccaattgacctgtgctgtaagtttaaaatacacattgaattttgaagacaagtacacacccacactcacacctatacccaaagaatagaaaatatgtcattcatactttttatatgggtaacatgttgaaatgatactactatggatatataggttcaacaatatatactcttaaaatttgtttcactcatttgtacgttaagaaatgtggctactagaaaattaaaaattccacttgcatcttgcatttgtagtttgcatgttatttatattgacagtgctggtctagaatgttgaagtaagatgacctggtaacagatccagtagaagatatcccagtagttcttccccaaagactaccagtgataaacttctgcaaacctccctttgcaaaaagtgcttttctctctggagtgtttggaagacaccattaatagatggttgcaaacaacaatcatcattcaccatgcacatttgacagaacttactattaagaaaggctgtagaagtgtaaacttgaaactaattaaaacccttgcctaaggaagccccaccaacccaagcaactttaagcagaaatctgtgattaaacgccgtgttgtgctagttaacatttccccagctgtatctccacattgtcagtgactcccctcacctcttgccatttgaaacagtaaataattgggtttctgttcacttccttgccttcttaatcacttttcccctgctgaagtccagtcatttagacataactggtctatccccttggaaaatttgaaatgtttttgatattgagacttaaacatctgtcacagctgtagcaggttcaggagtctcattgcctctttgctgttagtggtatttggcaaagtgctacatagcattacataaagaactactcactgatgatgaactcagcctccagtggcaggcatgaagggattgtttttggaatccttctaaggaaagctctcctttgtggtggaatgaacttccctcatctgtagtccccccatgtctcggtcctcatttctctagctgacgtctaccttgcagctggatcttgttagctgaaaactacaacctatttcttttgagttaaagactcaaaccatccatgtagccagtgatgctttgcctgacctgctcctgctccttctgtggccgcactcagcccactctcctctgcaccctgctccagccacattggctagccctggctcttgtccttgatcaggtcctgctgtccacccttatgtcctggccctgcagtgctctttgcctggaatacaccctccttccttccctctccacgcagctaactcctcaaagcttagctcctgaaatctccagcctttttatttgctgtcatgagggcctgaacttttctatcaaagtgcttatcacagctaatgatatatagtcaacatggttatataattatataaagtatgtgcttactacttggttttaagtagctagagggataatgtttgttttgttcactgttgtatcccagggttagagactcaataaatattcactgaatgagtgtataaatgtgtttgttatgttcctcctgcagactgctggaggcttcctgcaggtgctgtctgcatggcagggggcatttctctgtcctctcctccttctagcaggtggaggagacccctgtgctttagaccacaatcaccatgtgtggggtgatgggggtttaggcggatcggtgacaaggaagggggatggtatccccttcgcccctgaatcttgaatcattcttcccttctttattcccgtggcttgggttgattctcctcactccctgcaatttccttctctctaatttcacatcttctccctcttccccacagctcatctgctttagctgcgtgtggttgtcttccttccctttccacatgctgcccccaccctcctgtgagtttgacagtttcccacagagagcatcaagctctcttgggatgcatgtaggcacttttccatctgattatagtggtttctagttttaacgcaccctaactgaatcacacaggttcaattaacttcaccatatgtgctgccctttggcctagaacacagggctgcaaggcaggtacagagctctaaattagtccactggtagagaattcttcatctcctggagatcatagctgtcatgaccttatatagtaggtacagaatgacttgccttttgcataaatgagaactttctttcattggtaaaatcttctagctctcccttcaaagatataccaagaagaatagcacttctcaccacctccactggcagcccctgccctcacctcctccaggactctgctcaaacttgatctgataaatgtgtggacctaatgtctttctcttaacttttcattggactcctcctgggttttactctgaaaacagaaagacaaaccattgagattacgttaaacatgagcgggttaagagcaccctttcgggagtcatcactcttgcttgaaagtatctgatgacttaaaagagaccttagagactaaggcaatggtttcaaactttaaaaaaataagtggagccctttcattaagtgaaatcatatgtagaagactttacttctgcatgttttagagaaatgagatgtttggccatgtggacacattgctgagtcacatggtgcgctggtggcagaggctgtcagtaccttaggtgagaggtgaggaaagtgaggctgagagagtttaaattcttaatgtagacactgggagcagtgaaggggaatctgggcttgaaggtcttggctttgtcaccactaccaccccatgtcctctcaacccagccaaaccatagtacattacaaaggttttacaaatctcaaacaaacaaatttctggaaagcaccacctagactaaaataaatgcaccagcagctcattaccatcttaatcttcatcaaaatcatcatcatcaccattcaactaattgcctgtatttcattgttttgccaataagaagagtgttaggacttaccacatacatttgctaaaacaaatatactccccacctccttcaagtctgctcaaaggtcacttctcaatgacatgaccatcttgctggggtgtgcagttccctgctgtgccctcccctgaatgtccatcctcctatcctgttctgctttttcttttctttccatagcacttttcactttctaacatatgatataatttactttgtaaaccaaaaataaaattctaaggccccccaaccatctaaacagacttcctcctcagccagggctcttaaaatttaatctgaaagactggttcaggccatgaagggaagtggggtcgaacaggcctcatcatacctgtatggggcattaacatcaacacggactttaaacatttcacagcctgttctctctgaagcctgctagctaaaagcttcacctgcatgacaaaactttggtctccacaacctcttattgcaccaaacattcctttctattgatcccaagtctttagacaaactcaaccaattgtcaagcaaaaaatgtttaaatttacctatagcctggaaactgtaggtaagaaactaagtgcaagtttctcacataatgagcaacaaatgtcagctagtagttgttatcccatccccaatcaccactcttttaatctgtatgctctcttacaccttttgagaattaggacaaaaatttctcaaggaagagtggtgaccgttccccatcagacccatagtgtcaccaagaatgtatcccttatgatcccaaagtcatcctctctgaagagtagagtgtgtggtcccagttcagaagtgttcctgagtaacttgtgcttataactcaggacacttctgaacttggaccatacaggtctccctgcttctgttatctctcagactggtctgttcttagtcacactgtggaaacggggccacctagctaagcttccagcacttctcaccttatctgaaaaggcagccactctctgtccattagcattctactcttccttcaagttctaatcaagatataaccttcattcttggctcggtttgcatcaattctacctccttctgattgctcatggagtaaattttttatctcacacattatagtgcttcacagaactccttcctgcagtcctcaatttcttatgggctcgtaggtgcaaaaaaaaaaaaaaaaaaaaaaaaatctcccctgaatttccgctcctaactctaccataactcatggtgaactcgggaaattactcaaccattctggatctcctttactccattttatagataaggagttgaattgggtgatgttcaagacctcctcagatttcacattctaggagattacaggcagtttaacagcatggttcatgaccaataataacatgacatttctcattcacaagggcctggtagacccttcaactttgtcagttccaatcttttccataatcctataagggaggtactataatacccattttaaagatgagaaaaactaacgttcataactgttataaaacccaacttgcttaagtgagtctgttattgcaacagggctgggattctaccctgagtcacagcctgtgttcctttctcctttctgatctgtcctgtgtcttctactttttcatatcactcttagccatgactgacagacctaggcacaacaaatgacctgacgtgaactctagaagtgggttccaaaacttaagaagagggattcactcacattctcttggttggctctgtgacttatctgctgtatgggcagtgccgtgcactcttggggctccttgatgctggaagttgggcaaaaggaagcccacatggggaagaagcagttcttcccctcactaatgtacggctgtggacaggttatgtaagttctgtaagcctcagtttacaaacagtcttcatctattaaataaggacaacgatatctatctccaaagattgtgaggagaactttatatgaggaaatgggcataacatcagtgtgaggtgtttgtttttgtttcaaacaaatctgaatgcagaactcagcatgctatttagttctctcaaaagcacatacacacactagtgagcagcagagggtgatgatcttgtagggtgacgtaagagagggtttatatcacatacactgtagcaaacaacttaatattcacattctgagttgcctttcctcacacggtgctaagcctcactggttcctacctcccatccctcccccaattttaaaaacctccctgcttgattatgcagaatgcaacaccaccagctttaatttccaaactcatgacccttaatgcattgtggtgctcagaaaaccaagtccctgccagttaataggacttactctctttgggcagtctttggggttaaaaaaaaagattttatttccttgtacattatcatcatcattttcatcaacaaaaactttacctggtaacttagaagaatgattcagagagatgctagaaaatgggaaatggggacattgtagcacaattttcaagagattcatagatggatcaggaaaatctagcactggataaagtagctctggaatgagcctcctatggtcagaataactgaaccgactgtgtccagccaccaaagctcacctgtcactctacactggttgagtgtagactggagactcagagccccactggattctcacagctactccatctgtgaaagctcctgggagaggggtaaggcggcctccaaagaccacttggaattgcctcacccagaagatcagaaccctactttctgggcagatacatgggatcctctataatctggttcactagaccaatctcactgatcaccattcagtgagagttgcaaagatacggagaaatggaattaaagctatcaaaataagaaaattcctgatcaaaagttttcaactacttatctacaggaaaagttattttatgtgtagtaaactaaattcatttacaatgtctttgtgagttattaatcatccgccagtgggaggcaggcaacaggagaaacaggctgtgtatctgagagtgggaccccttaagagtgcaaaggagaaggggagaggagagaaggtgacaatatgttgcagtttcattattacaatttacaacagcctacacatgtttaatcctgattttcttctcttcacaaatcagttctcctgtatgactttccacagagcagaaaatgactatacctgaacactaaaaatttaaattttccatctttgcatagcatctatgcagcaaaagtttcacagatctcaggaattagaggctgggcaatgaaaggaagcagaaggcttgtcagtgacagctgtaagccttgctctcttagctagattttctccatcagtcaacttggagcagaatgagtgtgatctactgctaatctcccctgtggaattctcaacaaactccaggctgcacaggttatagacactaatgaaacgttatgggtgagcattgaggacaaaggctttaacatctgtgaagtagacaggagtctgcagcccctgagcccacccatctgcgtagactgcaggagctccctgccttgtatttggttgggtgctgttttaagtctttgtggggttacaactagcacattctgtttgatttgtaacacttcagcaaccaaccatataggctgtttggcagatagtcatttataaataagaataatatatattattcttattaagcataagaatgctgttaggcattttaaacggaaaagtttcatggctattccattgataactggatttacctgtggggtaacaagacaaagctgagtgtttttgccttagaatcctggggtattagaattgatctcgtttaagaggctctctctttctacatgtgaggaaacaggcccacagagaagcacagatgtactcaggtcacacagcatgttagaggcaaagccagggctagaagctgagtctttgaactctgaacagtttagtgctcttacctgacaccacgttttcgtagttttgtttaagatactctgtcccatgtgcagatagcaccacatgcaaatagctcttgaaaacatatttgtgagtggatgatgacaatgctgttggtgctgatttaattataggatgccatggggaaaaaagctctacagttttctaaatggaagggataaagttgaataaacaagagagttaaagcattgttccaggtccagattaaatgttccataaatactctttgaattaaaataaagagaagtaagtaggctatggaatttcgtcgggtaaagtattaagaaaatagaaccaaagcttcatttccttgatttttccaggcgccatgaaattgtttatcactaggaggggtattcactgtagtccagggaccacagtggtctttgaagtctccctgcatggtagctggcctcttaaggcaaacaacatttacagaatgtcaagtctacatagtttgtgattctcaaacccttctgtagtgagggttctccaagacagtgagttgtggtgcttgtggtgataatggcagtggttgcattggtggtagtgatggtggtagtggtggagatggacatgatggtggtggtgatgatgatggtggtgatagaggtggaggtggtggaggtgaggaagtggtggaaatggtggtggcagcagtgaaggtggtggcagtggtagtgatgagagatgtgccatttgcattcagcgttcaaggatgggcaagaatttcaatatgcagagtttgtgggaatggaaattgcaagctgaggaagcagaaacatatatatatatatatatatattttttttttttttgcccaagatggcaaagagaacagctagaatatgactggaatcattcagattagcaatgatgaggaattcactcacagcagtagcctttaggatagagaagctacagtaagtatgagagtcctctgaggatcaacagaacttgaccactgactgggagtgaggatggagtgagagtcatgctctgtgatcctctccatgagggcaagggcggggaattgtgtcccttggttcttccatagggtctgttcctgtgtttagtacatggtaagctttctgaaaatgtctggtatctgtttaactgctttgagtcaccctggctgaggaagtggacatgtggctggatttcacccttttcttgttccttcactctccctgagggtgcacacttgggtggtggcacacccgcacatgattttaattttcgtggctgtaacccagttcatattttggtcagccttcaggtaatcagccagagatgctagcattgtatactgctctctttccacagcctccattagaggagggaattcactggagggtaaggagtctggacaacctcacagaagaggtgatattgatctaaatcttggagaagggtagggttggatcagcatggagggagggcgtttcgagagggaagaaagcaggggctgaggtttaagcactggcacgaatggatcagttttgcaaaagtgggcactgttggatggactcattctgtcaaagtaggaaaggccttaaatgcttaggtaaagaagctgggcttaccctcaggacaggggcttttgggtcaggagaattagcgctcgcctaatatccaggagctctccctcatgactggtcttcattatagttagttgactgactctggcaagtgggtatgtgagcagaagtgaggcatcacttccagtcaagtccccttaggatgcttcgtccatccccctgtcccttctgtgtgcccttctagatgctccaggtggtacagctacaagatggcagagcctccatcacctaagttcctgactaaggagaaagattctcctggcctgggcgggacttacactgtgagtgagaaataaagttttgttgtgacaaggatctggggttttggattattttgttagagcaactattttgacagcctctaaggcttaggatcaaggtgagaaatagtggaggcagtgaggggcaactttgtacaaaaggggacatgtacaaagtcaagtcctcttcatctgtgaagcaatcagattctgcagtgctcttttgggcactggggagagcagttgattgtaaaactcatgaaatccctctcctttcctctggataccagcctttggcctgtgctgctctttgaacatcttggagtggttgggttaacaagtttgaaaagaagagctatactgaagtggaagcagggcccctctgctctccctaaacatcagccagtcccagtggaggctccttagaactccccatgcaactcagagtccagtttgaaaatgccctggtagcatgaaagggtgccagatttggatttggaagatctggatttaaatcctggcatcaccagttgtgtgatggataaatttaattgtgtgtattggggtaaatttcttgatcactttgtgttgtattcttaatataagattggatatgataattgcactttgtattgtacagggctattgtgcaaatagagagcagatgtgtaaacgacactttggtacatatttagagctttgcaaatatctggattttgtttgttatcatgaatgcatagctgtaaaactggttcagctggggccttactacaccctcccatgttgtttatggtatacattccagaaccttctcacttctttctgtcagtgaccttgcctcccacttcactgagaatattgagagcttccaacataggtatctcaacttctctctttacctctgcacatccactcattcttctctcttgcttcagtggaagatgagatcctcctcagacccagggccaaaccctccatgtgggctcacaccccattctattacacctctttcaggactttgctccaacagtcaacccctatctctcttgtatcttccagtacttccatcattcagtcagataatgtgttcaagtctcttgtatcctggaaaatgacattactatagcatgttgcctcataaagttaagtattatttttctctcctctttaccacatgcacttctgagagactagcccaagttccccatttccttgtgcatttggtgggaagaatagaagtaggtgccttctgaccacaattaaacagtcaattaatttttcatgggagtgataaatgtggtcaaataaagatagcgaagtgttttttttcagtcttttgttctgagtaggtacacagtacttaaaaaatgttctacaatgaaggaactaggtgaaataacttgctaacatttctttgatcctttcccactctgggttttcagcaacaccatttcttcattagttttttttttttcctactgtaggtggtgaaactatttctgttctgtaaagtacataagtatttggagacttgacctaaactttctcttacctaataaatggcacattcaggattagagacaacctggatctttttaaataggtggcaaaatcatggggctcaacatgttaaaagtaatgacagtgacagatcatcacagaagagtcatcacagaagactgtgggaggctaagccagtctcaggcacccttcctattctcagtcttggggtgagcatctgaccactgtccatgcccagggtcacccaaacttgaggcaactattatttactctttaaatccaagagatattttgtttttttctcttgctcagctgaaatgtgaacaagtgatttctctcctccctagggatctgcattaaggtaaggacaaatggagcatttggtctctccaatccttacctgttcctggtggtagtacaaggccagtggtatgctggtaacacttggctctttgaaaagaaaaacatccccagtttgtagcattctgtggtgtcaatacttgggttatagctaattacaatttcaaaatacaatgtgatgtcactgaacatggagttgggaagagatgtgcacagttggcttttgccagctggctctggcacactgctgaatatgccacacattctgttaaaaaataatacacataccatagaaaatctgaagatcgtagaaatgcagggcagatgcagagagaaaaaaagtactaggagacagattcattctccaaaaagacttaataatttgatatattccattctcaagaaagaaagacaattctatgcatagattgcttttagtgcttagtttttacatcattgtcattaccatactgcagttctgtttcctttttttacccaaacataacatgagcattttctcatgttatcacaaatttgtcctagatgttttcattttagaatatagaatattctaatgcataatcaaaccagaccatatcatggcacattgggtttgtttctagtttttcatagaaaattatcttttttaccttaaaattcatcctcaaatatcccagaaatatttcttggagatgcctgagggagcagttgtctgatgagaaagatgaagagagacctctgagaatagctgcctcaatattggccaatccttgaggaccacaaagccttgaagtgagcgactctcatctgttaagagacttccaggcttcagtccctgaaacccacatccctaccagccttgctcaccaccacatccagcttgctctaggagtggattctcatcccccaacttctgggttggtcccattagctaacccagtctctcccactttcctctcaaactctcctgctctgcctttgggttcctgctttgtggcaggcaatctcctgtcaatacttgaaattttaggaatgttctttttaattccagccttaatagaactctggctgcttcctgagaatatgtgttctttgtagttcttgcaaattaaggctttttttttttttcttttcttgctctcacatttattcccctcagaaccagcaggtggagtgagggttctcctgctcctccgtgccacttccagaccacttccccttgtgtcctgtcagatgccacccctctgaggagcacatatcctgccacatcttctttttcacttgctgctgtcactctccagcctcctggtcactcttccctgatcactgaggacctcagctctggctcggagcctccctcactatcccagcctctgtctcaccccagtgacttcatcctccttgaggaggaccacccagcactctggcatctcagtgctgagactcctcatctccagtgagctccttctctcttttgcatcagttatctgcatcctggccacacctgggatatgcatgactttttaaaacatcctgtccataaataccatgtccatcctcccaagtcacttgcctgagtacctctgctgttacaattctctctgtggaaactcacattcactgaacctgacattttcttcctattcctcagactcttcatgttttctttccttccttgtccatcaatctaatcactcctatacaagtcacctccaattcccttactctttcctccttctatgatactcatctgataaaaatctcaggctgagatgaatccagccacccacattcttgcccacagctgccccagaggctgaacccagggagaggtttgcgcggccaggttgactgatgtcactgtagattctcaggcccctttccttgcattctcagacaccacacctctagtttctctcctaccctgctggccactggctcacagccccttttatcaagtcctccttttctatcgacttcctcagggctttttctagaccttcttcagccagatctccccaggtgattaatctgtccccaaggttgtaaatccatctatgagcttatgactcacgtttttatatccatacctcagacctcacagaacacatatgtccactgggatgcatttcacaggcgtttcatgaccactgtcttcttccagcatttattccccattattgttagaataaagcataaactcagtgatcctacaatactctttatgatttccagcctgggatctcttcccttattcccattcttcctcacctaccatgccacccacacccccacacacatcacacactccacatagccatgctgagttttttcagagaggcaggatgatgtagtagctaatgagtgagctccaaagacagactccctcagttcagattctggttttgccacatacttgctggagcacttggacaatttgcctaccactttgagctgctgaggggatgaaatgagatgatgcatgcaaagttcttggcagagtgcctggaacatcataggtgcataatgaatgctagcaattattatttttaaatttagtttctttggcataaattataacctctctttcaaatctttgtgcatgtggttgtctcgatttggaattcttttttccaacaaactctgcctactgatttgcttccctcatcctccaaatgccatatgactaactcatatctaacctccaggactcagctgattactatcttggtctgttgagcatttcatgactctgtggtaatgaatggcactgtggatttattgcagcactaactactgtatccacatgcttgcttccctgcccaagtgtgcagtagactctaagagctttaaggtgacgagtgtgataggtcattgttttatctatagcatagtacgtactataaagtaagggttcataaatatttgctaagtgaatgaataaaatgataaatcacattgcagagccatagctctctcattgtgagaataagtcaaaaaataatgttcttggtaactataaggaaattttgtggttcagaagaatgcaaccttcaattcactgaatatttttggtaacataaatgtgtcccctgaaatagattactataagaaaaaaatactgttgaaatagctaatttatgtacttaataacatctgtcttcaagaaacaaaaggagacttccatgaaatgagttccaatgtctatacccagacaaccatgatgaaaaatgtggttgctgtattaaaaaaaaaaagaatgatgaataacatgttggacacggcagaaaactgaattagtcaggcagaggacaagttgattattcactgagaatattttagaaaaaggaaaacaaggtgaaaataaagataagaatataatagaaatagaagtgagattctcagcaatcctagcttctaataagaagatattccgaaagagataaaaataatagagatgaagcaaaaaataaaaatgatgtaagcatctttttaataagtcctctcattaatgatacttcaagactttccatattagtaatactaataaataaagcatcttaaaggtagatgaatgatcactgtgtaccagacactgtgctaagggttttatatacaatattttatctaatcctcacaataactcatgatgtaggtaatattattattcctaattttcatattgaggaaactgaggctcagaggagtaaaaagtaacttgccaaagtcacatagctcatgagtggtagctccactgtagattactttgggagtgagctcttgactcacattgggcaaatcgtcatcatgattctggaactgcacctgataaataaatgctaggttctctttggcaattgaaaataaaggccgggcacggtggctcacacctgtaatcccagcactttgggaggccaaggcaggcagatcatttggggtcaggagttcaagaccagcctgacctatatggtgaaacttcatctctactgaaaatacaaaaattagctggccatggtagcacatgcctgtagttccaactactcaggaggctgagccacattgcttgaaccctggaggtggaggttgcagtgaaccgagatcgtgccactgcactccaggctgagtgatggagtgagactctgtctctccaaaaataaaaaataaaaaaataaaaaaataaaaataaagacatgccatatgggttgcttgactagtggcatgctggcatatgtgagataagcagaggctcaaaaagcattagtgccatggggtttgtcctcttttcctgcttttgaactcaggccaccataaagaagcttaaactcgcctgttgggtaatgagaaacacatggttcagttacctctgtcatcctggttgacaatcttccaagtacaagataagtgaataaggcttcctaggttatccagcagccacatgacccataggtgactgcagacatatgagacactcccacagaattcagttgagctggcacaaaccagagcagccagcaatccacaaaatcatgacctaaatggacagttgttactttaaaccactaagtttcggaatgatttgttacgcagcaggaactaactgatacacgatcttacttctattatttgaagccaaaggttctaactgtaatagagtaaattttttttttcagatctaaaatatatcttggtctgaacattgacagtaagtgttaggttatgggaagacttactatttaaatcctgtttggattttctagattaacatataatcatacaagtatcttggggggtacatattaggttatccacaaaagaagatatcactttgccttcaaacaacaaaggagcaatctatgctgagcttaaaagaaaaaaaattatttatatatttataaatcgtgatattcccacaatttatacccaatcaagcagccattggtaagtatatgccaaataaaggtattatcaaatatgtaagaaagtactattttctgcagagaaactaccaaaagacatgattcagaatgatggatgatggatcaaaactgaaaattcaaaataatgaggccatagaactaataaactggtgattatcagtaaaataaaaatatatagagatgacagtaaatcattgtttgtggaccataattatgaaatggaatagaaaacatttttaagagagcagatctctattacttgttcccaacttatttggtcttggtatttctttacactaataaaaataattgaggactcccaaagaacttttgttcatgtgggtcgtatctatcaatacttactatattagaaacaaaagcagagaaccatttgacagtgtttgttaagttgtttaaaaataacaataatatacctagagcccaggtgttggtttctaatatcattccctaatagaagaaaccagggcttcttagagaagtggttgattgtagaactggggcaggaaatatacaagatgagcctggagcatcctgtagtagcacaaagtaagaaagtcctcaaaacacacgacacaacacaaaaagcacaaaactagaaactaaaaacaaaacaaaaccctcgaatccctgtaagtatggaatatgtcataatggggtatgtcaaagagatacagaagcaacctgaaagtggccccaatggccaaaactggaacaatttgagcaataaaataaattgagtaactcaaagaaattataccctgagaccaaaataaatacccatgagtccatactaacataaataaatgattgaataaataaataaataaataaatatgtaaatgatggagaagagacaaatcttcagtgcataaaaattgcaaagaatttatgtagctactctgcagtaaaggagtaggaacattcctctccactccttaaggatagccttcacacagtaacttccttccaaagactagagtatgggaaagaggggaaaaataataattttagtatttgtggagaaatctgacaaagatggtggagtaggggatacaagcctaagttgttatcagtttcaaatagactgttataactgtcagatattttacataagcctcatggtaaccacaaagcagaaacataaagtagatacataaaagataaagagaaaggaatcaaagcatactattatagaaaatagtcaaatcacaaaggaggagagcaagagaggaagaaagcaacaaagaatctacaaaacaaccagaaaacaattgaccaaatggcagtagtatgtacctatccataattaccttgaaaacagaaaataagtgaattaaattctccaatcaaaggacacagagtgcttaatggattgaaaaattaagactaaagtatattctgcctgtaagagactcattttggctttaaggacacacaaagactgaaagtgaaggggtagaaaaagatacgccatccaaacaaaaaatgagcaggtgtagatatacttgtatcagactttaagtcaaaactgcaaaaagaggaaaataatataattatataatgataaaggggtcaattcatcaagagaatataacaattgtaaatatatatgcacccaactatataaaacaaatattaatttaatgggtcttaagggagagatagacagcaacataataatagtaggggactttaataagccacttcaacaatggataaatcatctagacagaaaattagtaaggaaacataggacttgaaacatgctttagaccaaatgtacctgacagacatatatggcacattccatccaatagcagcagaatacacattcctttcaagcacacacagaatactctccaaaacagataacatgttaggatgtaaaacaagtcttattaaatttaagaagactgaaatcatatcaagtatcttttttgaccacagtgatatgaaactacaaatcaataacaggaggaaaaattctcaaaatacgacatacaaatggctttcaggtatatgagaaaaatgctcagcagcactaatcatcagggaaatacaagttaaaaccacaatgagctatcagctcagaactgttatgatggctattactaaaaagacaagagataacaagtgttggagagggtgtagagaaaagggaatacttgtgcatggttgatgggaatgtaaaatattacagccattgtggaaaaccatacggaagttcctaaaaaaattaaaaatagaaatatcatatggttcagcaaacctacttgtgggtatatatctgaaagaaatgaaatcagtatgttgacaagatatttgcacttccatgtttgttgcagcattattcacaataaccaagatatagaatcaacctgtgttcctcaatggattaatagataaagaaaatgtgataaatatacacaatggaatatgattcagctttaaaaaagaagatgctttcatgtgtgacaacatggatgaacccagaggacattatgctaagtaaaataagctaggcagagaaagacaaatactgcacgatctcattgacatgtggactctaaaacagttgaactcataaaaacagggagtagaatggtagtttctaggggctggaggtggaggggaatggagatgttggtcaaagggcacaaagtgtcacttaggatgaataagttgcagcaatctattgtataacataatgactatagttaataataatgcatcgtacacttgaaaattgctaagagagtagatcttaaatgttctcaccatgaaagaaatgataagtattgaagtgataaatattttaatcagcttggtttaatcatttcccaatgtatgaaaacatcatattgtacgccgtaaatgcacatacttttatgagttaaatatacttcaataaagctgaaaaaagattaacatcaatagtagtaagtcatattgatagcatataccctctaatgaggtgacaagaatggaactctacctctgtttttttccctaaaacatattacccctgtgtaatcatgaaaaaaatgtcaaaaaaattccaactgagggatctgccacaaaaaacctgatcactatgccttgaaactatcaaagacatcacaaacaagggaagtctgagaaactgtcacaaccaagaggagcctaaagagacatgaatgtaatgtggcgtcccggatggatcctggaacaggaaaaagacactaaagaaaaactgggaaaaaagtatggattttagttatgaattatttataaatattgagtttattcattgtgataaatgtactatactatcagacataaatactaagaaaaactgagtgtggagtatctgaaaactttttgtactatctttgcaacttttctgtaaatctaaaactgttctaaaatataactttattaaaaatggcaatgataaactcatcgaaagttaacataaataatacatgaattacaaactattctatttatttcaaaaaaattattaaagagaggggcattgttttgcatttttgcaaatccctttaatagctaggttgatagacatctggattctcatatctgcttctatattcagtgtgttgtgatatcagaaatcatggaacctctgaaaaactctactgtagactcatgagagaatgaaaaaggtaaataatgtcttcctgtctttatataagtaattttaacctcatatacctcttaaatgtatcgcaggagttttgttactacactttgagaatgctgacatatattgtagaacacacaggttataaactccaggttattaacagaaaaactggcaagggaatatgagaatagaaagtgacaaatttccttttcctataaatggaagtaaaaaatgaattctgttattaaaattatgtcaatagttgtcaatataatgccaagtgacattataaatattgtaaatgttaatagctatggaagtagggaatatttttaaaaaaactttaggataactatttatataacgaaataaaacatatgtatctttgaaattaccaaagataatagtcaacaaaccatctataaaggaaaaatagaaaaaagaggaaacaaaaaccagaaagtattaaaccaaatgatgaaagaagaccaactataacaatatatatagataaagacaatgagtgtggaaatgttcaactagcctattaaaagaaaaaagaatcttaagttatgaaccgatatcaaaatatactgtatgtaagaggaattctcacaacaaaatgatagaggaaaactaaatatatggaaaaaactaaaataaaatgatgaaaaagtataagtaaacaaatcagaggtgttactattaatactacaggaagtagtgttaatggcaaaaaagcactaaatagagatataaatatattttctgttactaaatgtataatctatagtgaaaacaaacatatcttcagcacatgtaaggcaaagcttttaaaaatataaagagaatttagcaaaaggacaattacaatgaaagattttaaggtatcactctcactctatgattggataagttatcaaaaatccataacagcaacaaattgaacaaaacaataagatgattcactaaccaactttgaatcctcatctgtctccatatttcaggccaaaaagagcattctaataagtcccaaaaggtaacctttgatatatgccatagtctgttttgcataagaaaggaaggaaagggaatggaggcaaggatgaaagaaggaagggggaatggaggaagcaaggaaagaagaaaggaaggaagaaaggaaggagaaaagaaagaaagaaaacttgaaatacattggacttaaaatttttctaaatacctattgagtcaataaaaaaatttaggtagtggtagattgtttaaaaagtaaagaatacgagagcactatatatcagcatttatggaatggagacaaaatgaattttattggtagatgttttcactatttgacaattgaaaataaatgaactgagtattaaaataaaaaatccagaaaatgtgcatttaaacgaacttaggtagggggagaaaaataaagataaaagatacattaaagaatgaaaggcaatagaattggtaaataaactattttggcaagtattttggaaaaaatagaggaagtagaaattaaaaatgtgaaaagatgatgtataattgtatgttattaaattaaaaagtcactatgaaatagatttttttcttaaaaatataaattaacaaattgaaaaagcagaaaaactataagtggcagtgatgaaataaaatgtattatagagtttctttcataaagggctcaagggcgagctggttttatgggtaagttcctttgctaattccaatgctattttggaaaacaaagacagtttttaaaagcatccctagccttgataccaaaatctgacaaagacagcacacagaaaaccaaacaaatattactttttgatattgatataaaaatcctatgtaatataactagtcagtatattaaaagcataacttaccatgaccaactaagatttattcaagagacacagggaatagaattaaaatgatttgcatacatggggtacattaaaaatatacttttctcaacagatgctgatatatttttacaaaactctgtcgtactaggaatagtataatgcttcttaaaataataaaatgtgtgactattgataaacagtcttctcagcagttcattgaacattgaacttaattgtgaaaccaataacccaaaacttacttaatggtgaagtattgtaggtgtttccagaaaagtaagaaagttaacaaaattattattacttaatactgtgaaagttatggtcttacaatacaacatgaagcagaaataagaggcataaccactagaaagatggagacaaaatcattatttatagatgatatgattgtattcctagaaaaaaacagcttaatcattattagaatcaataaattggctagataaaagataagctcacaaaactaaattactttgatgtatcaccagctggaaaaaataaaatcatttcaaaatcatttcaaaatttgtacataatactcaaatttaagctccatgtagttaattccttttccctctgaaatggttcctgagattatcaaaggaatgtaaaaattcgtctcagctctggaaacaagtgcaggaggtcacccactggccagaataaatttcttcagttactgagcagctgagaccaaactgaaggaggatctgggcagctgcaggaagaacaacctgtttgggaaaacaattttaaggaacttgctgcagtgctgaaggctgcagggtggagctgaggaagggcttgagagaaggggtgaggacaaaccttgaaccttctgtcatctttgggatgtacaatcggcatcgcggtaagaaactgacagctcgcgggccaatgtgcacttcccattggcttgaatatttggagacatgaaccgtaatgactaatgagggagagggcagggctctgaatatcctcaggctgctcctgtacagtgttgaggcagctgggaagggcagaaccacagcaaagccacacgtactcctttttaaatctggaatttaaagacttgagtagagacccctttaacttggaatctattttaactctccataccggactacagttattagaatgaacaaaaagggaaaatggttggatgtttgctgaagctaatgtgggaagaaaagtaaatgtctctttgtgagatagcttacttcaagaaacaggtggaaattcaaagtaattccatatttgtttttaaacgagatttgaggctgttgcacttatgagaagggcagaaaatacttctttcaaatgaaaacatggttacagaattaaaaatgctgttgcacttaggaaaagggcagaaaatactgctttcaaataaaaacaggattacaacattaaaaatgcagaggaagccgtgaagagcagataatctcttcatcttacagtttcatcagaaatgcctaagaattcacccagaaaccataaaatggtgaaagaaataatcaagttagtaaaatagtaagggacacggaaagtacacaatttatgtgtagcagtaactctgaaaggagagcagaaaagagggcaggccattaaaaaatgttgtttttaaaggagaatttccctgaactagagatctgactttagattaaaaggtctcagcaatgacagaaaatgacaaaatcctctacatatacatgtcttctggtgcggcttttgaaaatacaatacgaaatgaagcattacaataagataaagaaaaatcttaaatgtatgcaggcagaaatcacaaattatgtaaaatgggaaaaaaatcagatggtatcagatttcttcacttaagtaaatattggaagaccatggaacagtgtcttaagaatttagagagaaaatgattgtggtctatttttcatatattcattttatctcatctttttatttcttggtgattttttttcaagtgataatatttttattctagaagtagatgtcttaaaaatttcactttacttaatttaaaaatgcagtcaaggcaataatttattttcagtatagataaattattttaaattgcagaaaatctaaagtaaaaattttagatgacctataattccacatcaaaggcaaaaacattgcgtattaaattttgctgcataattttccagactttttacctataatccataagtgcatgaatatactttatgaaacatacaaggggcactaactgcacatattactttgaagcctgctttatttactgattataatattatgataaataatattatgatcataatatatgatcggtattattaatattttcacattaatgtgcttgtataatgccattttaacagttgtatagttttttgtatgaatgatccatcatttctttaatcaatcttttatgatttgatatttgtttctaattttacagctctataaaccatgctgacaaaatcttacataattgctgttaagactttctaagaatgtaattgctgattcaaatcaactacacatttgaaaactttgacagatattgtcaaactatgctcctgaaaacagctcccaccttccccataacctcactgatacttaacattttcattaagtttaacatgggccactcaaataaaggaaaaattgtatacattatttggaatataatttttcatattcttttatgagctatagtgttttgagggttgctttactcttattgataagttgcagtcctctatgttagtttttctcatatattataatctttttctcagtttgtcacgtgcagaagttcttcatggagtttcctgatatatagaatttaacaaactcatctataactatatctgtatgtgtgtatctacttatatatgcaaaccagcaatctttcattttggcttctaccttgagggttatgcattgaaagcctctactccatcccaatttatttggaatttatattggttttaagttgtgagaaaggaatccagttttatggttagtccagagtttccccagaatatgttttatggataatacttctgtgtgatgtttacaggattaatcaaaagaaggattccacaatcaaataagtttgagaagcagaaggtttaagcaaaaccactggatttcttcactgcaatacttactaggatggagactagtctttgtaatagaatttgaagtggcaaaacattagacacaatgcaaatatatgtcaatatcatactggataagtaaattatggtttctccatataaagaatactatgcagctgtaaagaaaagatgtgagaatgcttgcaatactgatgggaaaggatatccaagattgttaacagaaaaagtcagaatagggtatactgtatattgtattgtgcattaagaaaggagacagtaagaatatatgtttacactttcttagatggcataaagaaatgttagaaggttcattagaaaccaagaatggtggttgtccataaagtggtaggggtagaaacagggcgagtatgagagagagagagagaaaccttttcctaattacttttttacactttctgatttctaaaccacacaaatatgtataaatttttaaaaaaaatttaaaaaggaaaccctctcaaaggctccaatatgctattatatactgtgactatccaagttgtgggcagcggtagtatagagagtaatctacaaactcattcaagtacagaatcctacaattttaggttattcaggtttccaaaaatagtgatggaataatccttacaaatttgacatgctatctttagcacatactaaacacaaaattttatacgtttgagtttttgtgtgtgcatgtgtaatttctagtctgcttttattaaatgattctacccctagtactgagtattttgatatctcgaatggcaagtcatttattatcattctcttaaaagttattttgctgatataaaaattaattcttgttgtttattattttcttgaacgagttttatccattaactctttcagatgattcactttatcaaactgcctaaacgtactcttaggaatagtttgagaagaactgatatccttaggaattatataaagatagaagggaaactgttttctatatatccttaaacactttctgtgttttgaatcatgtggaatgtagttctcaaatattttcttatgccgtccagtaaagtctaaattagcatgatatttttcattttgcttacataagttctggctatttcttaattattctaagggttttcactttttttttgaaaaggaaatccatttttcattttattttgtcaaggattattgctgaataattattgctgaaataagctacttttttcttcaacactacattttaacaaatttaattttggcatttcttgagacaaatatatgatgctcccctttaacaatttaatttgaagaaatataataacagatttcctgataatttatttgctagtattatttgctggaaaaagtcatgctcaaaaacataacattactgtttcaatataatttttatttttttggtgaacgttttaattgggatgtttgcatctatatttgtaaatggagttggtctgaaggtttgtttttggagttgtctttgttagctttctatatttaggttttaccaaatctccataataaatgagcaagatttccatattgttctgtgctcttgaagagcttataagagtatttgaaagatttttccctgcacagattttgatcccagtgccttttgtaaatgtaatttttgaacagtagtttcattcccctttacctccaagctgtatcagtttgataatttatggttttgtggaaaatcatccatttattcttattgtgagttatgctctctggcctctgtgctttctctttctccatctgaggacagctgcctccggaagttgatggcagcaccccaaaggagtcctaaattgggtggacccatctttctcaaggcttcaaggctcacactttcacctcctaattaggggctattggtatgtagaggccataaagcacttggtggctgcctcctgtttggcgctatctgcacaatgtctaccagaaatgtagtaaaatttctggcatttgtgtggcaaccttcctagtttctgcagtaacgttggctttcctccttttttcttcttccttttttttttttttttttttttttactttgttcactctgatttctgtctgggagtcaaggttaagggcatgtgtttatgctagcatcttcccctgcagtgtcaatgcacttttccctctccatttaattgcttttcatcaaccaaagcgataatactaggggctctgggctgtatttataagtgtagtgggtgtcaggggaagagagtaatcacaacagctagcataaacaatcaatcctggaaacacaaatatgttgacacccctttggccaaggcctagagcagcttgccaaaggatccacatttttttttaaatttgtaaaataatcaagaagacggaaaatttaagaagtagtgctgtaggtatatttttaaatattcctctcttactccctgttaatgaggtgattttcaatttttattattgtgaacgaaagtaaagaatacacatagatataaaaatttcggctgatttttgataatgaatcataatatacaaaagatgaagtaaataatgacgatggcatatttttgtagtctgctgttacagttggtacctgtagagaattatattagagctaacatattcatattcactcacatttccacaaaatatccagttaattaaatgaacgattctgttttctaacatagcctcctctcccactattattggtaatatttagaattcagaataggaatgtcttacttcttgctaaaactctaccataaaattatgtacatagaaatttaattatcagaaaatgacatatgaccaatattaataaatgactcagggaagcagaaattcccagcttgtctaaatctcatttttttggatgtccttttcatttttcatcctcattacagattttttcttggccttgattgtgggttctctgatgaagaaatgttggctcattcatcttccttgtcctcaggggcattgccctagtaccttctgagaccattgccaccctacagcccacataacaactacaagaatgggcttagctctcattaactttgaaagctactgcatgctcctcacagtttttatagaaaaaaggaaagggtcagtgcattttgcaaagtcaaatttttcttctttatacattcacctttctttctctgtgctttcttcttcaatgggaagagtcacctttgattacatgtaaaatctttatcacctgtcagtcatctccaccttcctagaacttcctgtgtagtgtcatagttttgccagagcagccacgctaagctgctgggttgctaattattgcaggacttaattacaaattatgataatattatattaatgatgagcctaactccccattttcatgaatgttataatgttagcataattatctataactgtgaattgtaaacacagacagggaatggcagataaaactgagccagttcccccagggatctaggaatatagctagaagcagctaactttgaagctggtggtttatcttaccagtcagttaagagaaaccactgaagtaataaattttcaaaggaggggatttgttaacatacgtgtgtgtgtgtgtgtgtgtgtgtgtgtgtgtgtgtcttcacatcatgtcatagaaacaattttaataacatagaaattgtctatatggtaaatgaaataagcagattataaaatatatatatatgaatgactattaaattataaaaagatgttcgtccccactcctaaaagggaaatgagcattttaactatgagatcccattctcattattttcccccatcagatgggtaaaaatctaaaagcttgatgatatactttgctggtgaggttgtggagaaacaggaactctcacacattgcaggtgagaatgtaaattagtacaaccttgtatggagggcaaatatcaaaattaagatgatatagtctatttttgagattttatgctataggtattcttgcatgatatatataaatgttatgcatggtggcactctgtaatagcaaaccgttgaagacaatctaaagtccaccaataaatgattggttaaataatagcatacattcaaaaagcagaatactaaaaaaagaatagagaagaggccgggcacggtggctcacgcctgtaatcccagcactttgggaggccgaggcgggtggatcacgaggtcaggagatcgagaccagcctggctaacaccgtgaaaccccgtctctgctaaaaatacaaaaaaattagccgggcatggtggcgggtgcctgtagtcccagctactctggaggctgaggcaggagaatggcgtgaacctgggaggcggagcttgcagtgagccgagatcgcgccactgcactccagcctgggcgacagagcgagactccgtctcaaaaaaaaaaaaaaaaaaaaaagagaagctctttatgaataatatggaaatatctctaagacatactgagtttaaaaaaacaaggtgcataacagtgtgcataataggctatattttgtgttataaagagggaaacaatctatatttgtgttgacttgtacttatataaggcactttaaatttttataagacaccacattttttttcttcttctttgagacaggatttcactctgtcacccaggctggagtgcagtggagtgacctcagctcctctcaacctctgcctcccaggctcaagtgatcctcccacctcagcctcccaagtatctgggaccacaggtcagcttgccaccacgcagagctaatttatttgtagagagggggtttcaccatgttgcccaggctggtcttgaactcctgagcttaagcgatctacctgcctgggcctcccaaaaaatactgggattacagtcatgagccactgcactgggctccacaattttttttgtttgttttatccgttctactgatgatggatatttgaaacatctccagtttggggggtattaagagcaatgctgatgggaacattatgtttgatgtcattgagtgtatatgtgaatgggttttttttagggtaattacctgcaagtggaatttctgagttatagggtatgcatagcttcttcttttctagacagtataaaagtattttctgggctgggcacggtggcttatgcctgcaatcccagcactttgggagggcaaggccggcggatcacctgaggtcaggagttcaagaccagtctggccaacatggtgaaaccctgtctctactaaaaatacaaaaaattagctgggcgtggtgatgggcgcctgtaatcccagctactctggaagctgaggcaggataatcacttgaacccaggaggcggaggttgcactgagctgagatagtgccattgcactccagcctgggaaacaagagtgaaactccgtctcaaaaaaaaaaaagtattttccaatgtaattatcaatttatacttcttctagcagttgacaaatgttcttattgcttagtttgaaacacttagttttgtcagatttcttaatattttctagtttgatggctgtgtagtaagatctcattatcactttaatttgcatttcactggtaacaaatgaagttgtgtgcctcctcataatatttattgactttgtggattgtgtgtgtgtgtgtgtgtgtgtgtgtgtgtgtgaagcccatgttcaaaacctttgctcattcttttattggatttcctgtctttaatagtgcttaatttaattgatgttttagtaaacgttagtttaactgtatttgcaaacgttagtaaagagtttgaatgaatgatcatggttgaaggtccaccatacagccagaaggcaggtgcagcaacctgagatttttcacaaaacattttatgtaattagcttacacaattattcatcaattaaattgggtctaagcatcttcccatcacactgtttgctgcctgtcatcttccagtgaaaccagattaatgaatgatgctaacattggtagttaacattcactagacccttacccctatccagggcactaggctgaggacttcatataggttatttttacttacatctctcaatgcttctttgtggaatgtacagctgctcctcgacttacaatagggttagatccagataaacccatcataaattgaaaatattttaagttgaaaatgcacttaccacacctaacctaccaaacatcctagtttagcctggtttaccttacatgtgctcagaacacctacattagcctacaattgggcaaaatcatataacacagatcctattttataataaagtgttgactatctcatgtaatttattgaaaattatactgaaaatgaaaaacagaatggtcgtatgaatactcaaattacagtttatactgaatgcatatcattttcccaccattgtaaagttgaaaaatcgcaagttgaatctttggaaatgggggactgtctgtactattaggctcagagccttaaattgcttgaccattatgactcagctagagagtgatgggactgggagctgatcgctcatctaactccaaaacacacactcttctaattattatactgcctcaaaacaagtttccatctggtttcaaatttgggattgttgtgtactgtgaaagtggcaatcatttcttctaaaagaagagaatataattaagtagtctgtttagacatggtaaaattgaaattgtctagaaaaataatataatgtattatgaaggatactgacaaaaagaaaataggtttgaataaagctatgctatgcacttatgtttccatcactgtcattaagtgaatgacaaatatactattttgatttactattgtatcaataaacatgttacacttcatgaatagataacattagatgctcttaagccaagcttactttttagattaaaatgatgaaataaacaacaatggcaaacataactgtacatccagtagcagctaccctaaattctcaaagcaaggaaataagacaatccaacacatcatattgagtctcaaagagattttctagtcattcataagcataaaacaccaaaatgttcaaaattaagactcccccaaaatattattcttttttggaaaagaccccagagatctgtgggaaaattaatctttatttccaagttaaactttgaatttgttgtaagattaaagaactatgagtattttgaaacaaaagttgtagaaagtgatcagattttgaaaagaccatgaaaactaagagctgagctacagcccgtggaaacaatgggagatatttctgaaacagtttatataacgagctttaattcggagattttttttttcccttttgaggaaaccttctggcttgaacatgttcacaggttctgtatggcttgtaaagctgtgttctttctcccgctgggaccttgctcaggcttgtagtttcatctgaaagaataattttcgatatttcctaggctgagcattaatccctccattgcttgatcgattaaatcccactgtctgtgtctggaaggcgatgtctgagctttatgtattgctttctggcaagctacatttccatgctcatggaacagatgcagcagggtaactgtgtgcaacaggctttcagccctcaaagcttgggggaaatgacaggtatggtgtcccattttaacttaagtttaaaggtctcataattatactgctatctgatgaatttggttcataccttttgtatggcatttagtagcttacaaggtgagaatacattatctcgtttgatcttcacaagaattgtttataggaaacagagctctattatctctcattttaataacgaggagaggctgtgacccttgcccagggtcatatggccagtaactggcaatcttgtaattaaaattcagatcttttgattctaacaccagtgttcttttatgattcacataaaaaacccgagattggagaattatagagggctttcaaaaagatccacattatccatgtgctctgagtccagaaaactaactgtaatataaatgtcacattgtggctcacttgagcagaatgaaacaaagatatgccatttcaatgttgtttcaaggataagaagtcttggagaaaattgctgggatacttcgagaaaccctaaatgtgatcaggcaggcccctagaagataagtatgtctgccctgtcagggacctgtaactcataaggtctcaatgcctggcctgaccttcccatgtgtttcacctgcacatattctatttctccagctgtaaaatcctgggtgtaggtgtattgttttggtcttccgcaaaggggaatccttatctcaagattttcaagtgcaagtaccttattcgggagaagaaacaccagtaggaaaagggagcagtgatatagggaagatgcagtggccaataaagagtacattacccaggcagctacccgtggagattaatcccacaaggaaagctcggacgtgatgtaaaacacaaaccacagagacacactcccctgaggggtgagagatgggtgttcagatgccagctccccttaggcattgttctttttttttggcagtgcaaagtgaaagcaagtttatgaagaaggtaaaggtataaaagaatggctactccatagacagagcagcccctcaatcattgttgagagctgctgggagtgggaggtaattccccaccttcctgcaacctgtgcaggagagaagagcggcattctgtagcttaggaaaaagttcctaggcaaagaaaggcagatcccggcagggtaatgtctctggtaaaaggcccgagggatatggctctgctataacaggatctagatcttacacttcaaaaattatctttcaatgctcagaatagtatttgggatactatagtcccctgacaactgtggacatatcaacctgatatgagggtatatgtgagaaatgcttgcagatacacattaaatctgtaccaacaaaagaatatggaaagaaagaaagagcaagaaggggccaggaaggcagcctgcaccatcgtttctttggcatggggagtcatctctactcacactttctcataaatcttgttcggatgctctggccattcgatcatgcacacgactctgctgggcatggtctctgtggttgagtagtagccctgggggaaggccagcaggagagccaggacccagatgacacagatgaccactttggtggctgtggctgacagccggggctggaggggatgtatgatggccatgtacctggaacagagaagaaagaacaaagttctgatctggtcaccaaaatctgtatcagagattccatatttttcctgccaataagaaaattcatagaaaccctttgattcctgatgatttgtacaattattttccaattccttttccatattctacccttaagctttgtgatatgccatacaatgccaacatgcgtaagaaaagccagctagatttttcagtatttcagaacctatctagcagcattcaaggagagacattttcatcattgaaatgcttgtgctggggacaggacagccaagtacaggtaagtgaaattagaaaaataagaacaatgttgtaaatttattcaatgtaaagactgactttcattctttctagattaagggataatggtgatcagaatagtactttttttcagtccttatgtgatattataaaagattagcagtcctacctcggtccatacaatttgaggggaagtaaacatgtctctgtgacaaagcattggcctaaagtcagcaaaaaacaacagctcctggagaaatcttcatcaattctttgagcatctaggagtcagtgtatggctaactatacatacttcgtgaagagaaagacggtctccacctgctgaggcagacagactagagtgcacaaaggaccagtatggatgacacttcattgcaggaagaggggagcacagcaaatgatgacttcatgtctggagccattcctccatcgcttcattcctgggctctggcactaaacagtgtcatctgaatgaatgtgtccacatgtttgagtttgtgcacagcccctgagatgttgcagagatttgaaggataagtatttcatatcagcctttcatatcagtgataagcacatcaattctgcctctttcattttaaaagacatctctctctgcatatttttcttgcaaagtttatagctctataccttaaaataagcattttttaaaagagaaggaatgatatcttatagggcctttggcatttaaatattatctgacaaaacctcagaatcacacattgattctctgacagtcaggtgtctctgacgtccatgcgacagaatggtcaacggagacttcaaaaatctgcaaagagtagcagagctgtcagctggctccacatcgttccacataattcttttactgtattctttggactcctaggatctctagaccagaattaggaccagggttacaagtaaagcaattttattcagtatgcgctcaataaattcccactggacacctgccgcacatagagcacagcgtttccttctgggctataagcttgtaatttctccagggagaaaaggtgcatcaataagcagctcaaaacacagcagtaggataagtgacctcaagtggtaattggatcaataccttagagtcttaggggagctgcggagacactcaagccctggaatggcaggtggtctactggaggggcttcgacaggtgtgctggatttggggtgagtctgctgagcatcctgccccaacgggaggaagtgtttggagctttcttgtttctccatgttaggattaggctttgtttgcatgaaggcttccttgagcatcctcttatcactgtaaactttagaaacttttctctgcatttttgtgctagggacctgggatttccctctctggtctgtaagggccactgaaggtgtttagtgtatagagtatgtctactaggaggacacttcatgccaacctttatatcagaagtcatgacaactcccaggaaggaaactcctagaaactctttcttctgcctcttttagaaagtgggtaggtggtcttaaagtgaggagagagtggaattataggaacagacttggaaaagatatgatgttgggggtgtgtagtaatctataaatctctgggcaagtttccctggttctgttgatactataaagcctatcactcaaatgctgtctgcaggtcatcaaaagggcaaaaacaactctcaatatgttacaaatcaaacattgtctgttttctttaggttaccccaaaatggccacgactactgccaaggcaggtccaggacaccatagactagatgaccttccatctctggggtagtcccttgaaaaggaccctgagaagtgttgatttctcccctagacctgtgtcttccttgatgcctgacagtggtggagccctgtatcctcttcaatcatggggtgcggtgggtgggggaaactcagaatcagagccaacacatgtgggcctgttcaaccattatcgttgccgtctttccaattcagtgaagggctggacccagatggtcatggccagaacctctttgagtgtttgtattaaaaccataggattgcttgttggattatttcccaaatgcagcggtgaagatgccttatctcacctccagcactgcatagttcctaccctcactggcagctgtgcattctcaggcttcacaggaacttgaggaggatgctcaggggagaatgtggtaattacattgccctcttttaatattacctcaaatgcaagattttaatttgtttctcattcaggataaatgctcagtcttaaataaacaaatcctaacaccactccccatgctcgaattggcgatacaccattcagaatctaatgtgactgggcttacgggggattgcaccagcgtattggcactgtaactccaaatgggtggcagaaagccatattttatccttattgcaaaaattgcaatttgggaacgcacttcagttaactctctaccgttctttagtgtaggagccattttagtggcagatgaaagtattacccacataaagccagagagaataaaaaagactggctttaaaaaatgtatatatgttcatttgttcaaaacagaggtgtttataaatctccctccctccttccttccctcctttcctctctttcctcctttcttctatccctctcttgcaatcctcatttctggggctcgtttaacatgtttttttcttattcacccaaaagctagtaccatttggataacctgtacacagatggatgaatattttctttcctactccccacttctagctaggattcattaacatacatttatatatttatctggaaccagcctgagcaattcttgcttatttggttataagatattacggagcaagtgctgcaaacccaaggaaaatacattcaataaatatttattgactgcaccgtgctcgtgggactctaaggcagtcaatgaaacgtctttctggtgtaagcattaatcattaggctgccagcgacagggatctggaggcgtgtgggatatggattatgttctttacttcaggtggttccagtcccactgagggccatcaggactgatttgaattgtatgtgtcctcccagctgaaaaacctgagatgtagccttcctcttgcatgatgatgctttataaaaagaactctctgctgcacatttgttttttcttgtaggcagagtgaaaacaatcttattgtgaaaaggaatttcaatcctctgacaagcggcagtatcttcataacttcctgctataccagtcccaaatcactcagcagagagaacgtctttcctctacgatgagatttgtccagtggggcccttcttccacagtctttctcatccaattccagtttctgccctcacttctcccactcactcctggggtgttacaagtttcctttaagggaccacatcttcctgagttcagataaccagggtggtaatagctgagagtgtggctgctatagtctagctcaagggttggcaatttttttctgggaaagacagatattacatattttgagttttgtggtccatatagtttcagttgtaattatcaaactctatctttgtagtgtgaaaacagccacagacagcaaagaaactattgggcatggctgtatgataataacattttatttacaaaaacaggaggtaggctgcatttggtccctggcccatagcttgctgtcccctggtctagtttacaggaagcgaagagcaggaggaattagaaccataggagaagatggtgtgatattcagaaacactctttacctttggcagatgggaactcattgggtagataactcctgtgtcccacaagcagtgagtaaggtggtctacggccagtcatgaccaagaatcagataagaccctggttctaatgtgagcacagtggtcaatctgggatgtttttcctcctcgatcccttcctggctgttcctgtttattttcacaacttggcccagtcatcatgtccttgtggctgtgtttgttgcctgcctttactgctgtgaagatctctaaaccttgtgctgaccacgcttcactttattttctattttcttttcttttcttttttttctattctttcttttttttgttttgagatggagtctcgctctgttgcccagactggagtgcagtggtatgatctcggctcactgcagcctctgcctcccgggttccagcaattctcatgcctcagtgtcccaagtagctgggattacaggtgcctgccaccatgcctagctaatttttttgcatttttagtagagaaggggtttcaccatgtttgctaggctggtcttgaactcctaacttaagtgattcactgtcctcggcctcccaaagtgctgggattacaggcatgagccaccgcgccgggcctttatttttctaattgcatatccttcttttctcttttcaccctccacaggtccttggcctgcccaggtgctgaggatgtagtaaatactcattgaaagtttggttgcataaatgatatcttggcacatagcagtggcttcatgaatgcttgttgagtgaaaataagtgtaaaaggagaaaaacatacatgttatacctttattcctcccagtctcaacacatgtaagactgttatgtgagaataattattgctcaaagtgttttctgtcatatagacacccaggatcatcctgaaggagtgacctcactggaattggctcttcagaattttttatctcttgacattaagcccctaaatagagcctcaatacctacttgttgactaacttttgtgttgactatacgttgggaactgtgcaggattcagtctttcttagttttttatagctttgattttaggttcaggggtacatgtgccaggtttgttctatagataaactcatgttacaggggtttgttgcacagattatttcatgacccatattaagctagtacccaatagttattttttctgcttctcttcctcctctcactctccaccctgaagtagaccccagtgtctgtttccttctttgtgttcatcagttctcatcatttagttcccacttataagtgggaacatgtggtatttgattttctgttcctgtgttagtttgctaaggataatagcctccaactccattcatgttcccgtaaaatacacgatttcattcttttttatggaagaattatatatatagtattccatggtgtatatgtaccacatttaaaaatcccatctgtcattgatgggcatttaggctgattccatgtctttgctattgtgaatagtagtactgcagtgaacatatgcatgcatgtatccttataataaaatgatttatattcctctgggtatatacccagtaatgggattgctgggtcaaatggtagttctgattttagctcttcaaggaataaagacttgaatgtgaaacccaaagctataaaagccctggaaggcaacctaggcgacaccctcctggacaaaggaagggacaaagatttcattacaaggacaccaaaagcaattgcaacaaaagcaaaaattgacaaatgggatctaattaaacttaagagcttctgcacagcaaaagaaactatcaacagagcatacagacagcctacagaatgggaggaaatatttgtaaactatccatctgacaacggtctaatatccagcatctgtaagggacttaaactaatttacaagagaaaaacaaacaaccccattaaaaagtgggcaaaggacatgaacagacacttttcaaagaagacatacctgtggccgcaagcatatgaaaaaaatctcaatatcactgatccttagagaaatgcaaatcaaaacctcactgagataccatctcataccagtcagaatggctattttgaaaagtcaaaaaataacagatgctggtgaggttgtggagaaaagggaacatttatatactattgacagaagtaaatttggattctgtctttctatatggcatcaccctctggctcttcttctgaacaaattgctccatccattctccttccatcctccctccgttttagggagcacacagtctttttacctgaggtcactaacatttcatcagttgagattttcttccaggatatttttttatcatcgaaattcagggatgttatttaagcatatcactcaaccagcatccttatctattcagctaagctcaagctcacaaagctataaccaaagaggcctttagcagcctgcagagatgacacaaagttcacacaccactaaatcatttttattattaattaattattgtttattaatattagcagcagagtcttcgcatcctcactgctatgttgtgcacaattctaaaaagcatgaggttttgatctccatgcccagtgctgattcacagcatcatcagtggacccacttcaaaaggtgccagctgatagcaagggcgccatcaacaagaccataaaaaatgggtgcaaagtcagatggatttgaaggcctgcgacagtttagggtaaagtgaaggaggggatgcagttgactgttgtttgagctgttctgtctcatgtgtgatcaaacagtgacccatattgttcaaagaagattcagaaatagagtccttgggctattaggaaacaaagtacctgatgtaggagctcatgagacgaggtgattccagaccctgggagccttccagccttgtctagattctacttcctatctcactactatctgtagaaattttgtttatcctttaaatgtggatcagaacccatctctttcaggaaaactttttcaatcgttcaaaaatctcttggagataatcataaccacattctattgaataccctcccatactcctgttagctgtcctcccttatggaaccatctcattttattttatagcagaacaatctgtgctcctgttctatcccatcactggacggtaagcttcctgagggcaggggttgtgttcacatatatttttgtcttttgggaaacttaccaaagagccttacacaactggtaaaagtttgcctggatgtgccagctgatgtttgaccaaagaactccatcttcattcagcagttgcaagctggcggctccacttagggcattcagactagtcttaaaagacaagcttacaaagggacagatacaattctggagtattctttccacagtgaactccttaatgctattttggaatgtgaggcactaagccaggattgataaagcgccctagttgggcatagatagaaggtgccccctaagcagcccaggttaagccctttgatttttgcagagccagggctaccataaaaatacgtatcactaaggtctgatgtgaacgaaggggaaaaaacagtgaaggtccaagttgtgtataatattctgagtgtttctgccagcaggtgggccagacagtaagcattgggaatgagcaacactaggagtatcagtcagctaatcgctgggatcctgccattcacaataaaatgctacccctcaggggtgggactggggttgggagtggctggggtgaagcaggaagacagagcgcgcatttttttctccctgaaaagagcaatggtagcaagtttgtaacacaatggaaggtgagtaaagtaatgtaccatttcatttccagcttgagggctcctgtcaaggattggcagaagctacttgttaggtagctcacaacatttgtgagctactgttttcttcctatatggaatctcatgcttgcatttgggactccacccctgaggctgtgctgacatgtataagacagacacacacagcaatagctatcccctgggcaaaaggctgatgctactgggacaaactagatcctttgtgacattgacctgtttgcgatttagagctaaaacttaggtaggaggtgtgtgctgacacacgggagactcaggtttatagaaatttgactggggaggtgataataggaccacattagctccagcagcagagtaagaaaaaaagaaagaagagagtagtttggattgtaatgtctttgagattttaattaccgtaagggaaaggggaattgcactgattgaacttcatgattttagtggaaactcaataatggaaagaagttcaaatttagggcatctttaaaattgttgacactgtgctttttggccgctgctgtcactgcagtattgagtagtcctctctggtaagctagttaggaaaatgtagttggccataatcttagaattgtattttcatcttatgcagtgtggccttgatattaagttattaaataattaatgctctcttctgaccaattttgaagtttttgtgaacaacatcaaagatgcatttcttttagctatttgaaaatacaaaataaattgtcgttgaatggattttgaatgttcccaaccccccaaaatactaaatgtttgaggtgatggatatgctaattaccctgatatgaccattacacatcgtatagatgtatcaaaatatcacactgtacctcacaactatgtacaattattacgtgtcaattaaaacaaataaacaattttttgaaatcttaagaaaatgatgcattttttggagggctggatcatccattccattgggcctggcaggctatgtaaaaactgctgcagtcactcacaagtatatttagagtttccctgattctctagcctcctctttccccaagtggtaagcatgttttctgggtgaccatagggtgaccattgacttaattttggccgcagaaaacttaaagcagaggcacttggggccaaaggaaggactaggaaggggaatgatatttccctgcctcctcctcactcagggtagcctctcttctcccacagatctcttttattcgaactaaaaagccagaatctgtgggctgggattggagtgaggtgagtgaggcactcacagtgcaagtgaagaattaaatcccgtctttatttaaaatgttgatattttgttaatcatagatttttgtgcattgtttgatatcttaatgtattgcattaaaatattatttgtcttgattactgaatttttggggtccccttaaattttgcaccccaggcaaatgctacacttgcctcaccctaatcccagccttgaaaatgtctcctgctgaagtatagcaggtaagacaatcactaatcaaatgaagtgtactcagactcaggtgctcagcattattcagtgctgctgcccctgccaggcacctgatgtaccagtctgttgtgctgcgtcctgtgcctgcagccaccagatggggtggcaggctcagcaggaagcccctaacagtttaagtaacatgaacaggaaagatgctgagtaatccttctctggagagtatgaagattatttgggcacccttgctacagtgattttgctttttcttgtatagtgtaaatccacaactgtttatttatttttgatagtgctttcttagttaaatctttgacagcaataagttataatttcaaagaagcacacatcaaatgaaaagtttagtactggatttctgcttttcataaaagttgatgatgaatgtgtaacttgcacaaaatgattttagacatctaccttttatcacaccaaagcgttaatcactgaacctgtgaaaaccaaaagacacacatctgctgaagcagcagcagcatctacaccaaaagttagtagttattttaagacaaccgtgctcaaagacaattatttaacctatgcagggaaaatggtgcatttcctcatcattctgtgaagcatgacttctcgcttagattaaatgaccgttgttctaaattaacttcactctttttcaattccaatgtttcttgtgcatgtacaaaaggtcgagtaatagctattaatatgttggctcagttatcagaagaatttggcaaatagctaaatgattctaattttctatcagtgtcatcagagttttcaaatagaaaatcagttaatatcaataatgagccaatttttttttctttttttttttgagacagagtctctctgtcacccaggctggagtgcagtggcactatctcagctcactgcaagctccgcctcctgggttcacgtcattctcctgtctcagcctctcgagtagctgggactacaggtgcccgccaccatgcttggctaattttttgtatttttagtagagactgggtttcactgtgttagccaggatggtctcgatctcctgacctcgtgatctgcctgccttggcctcccaaagtgctgggattacaggtgtgagcccccgcaccctgccaataatgagccaattctttaaaaaattcaactcatagattcaaagtttttggaaggtgaaataatggacattgttgtgaatgttatcatgggtccatttcaaaattcagcagtgaagattaatttgttttggtactaatatgaatacattatgataaaaataatgcacttactaaattaagaaacccatggaacagaaatgtacttgtaataggttgtgatacacataatttgcaactatgtacaaataaactgtggtatcttactaattgaaacagaagcagtagttgaaatttataaaaagttttgtaggtatacagtaacggaactaatttattttgggtgtgtttttgtatgatgaatacaaaagtatactacatagtattttaaaagtgtttgagcctttgactgttttatgaattaacctaagtaacagtaccaaactttttgtaaatgagtcctcaaagttttggttatattttatttaaaattagttgaaaattgtaaatcaaaatattttcaatggagtactcctacatttttaacttctgaagcttttggcaagttgcaatttctcaatacaaatctggcaaacaaaaaagacattgaaattcatttctataaaagccagagacaaactgcatgaaataaaaactgaaagctcctatggggtgcacaatttaatttggaaattcttgattggctcttaggaatattttgattagaggaaagaatcttttgatggatttcttgttttttagtaaattgttaatattctctatcaaaataaagtataaaattgagaaaatttcatttctcacaattatagtgattaaatttggcaaaacactaaaatgaaacaacctgtcaactaagacaacttagttttgtcttcttagttttatctcttaaatctaaccttctgtacctctgtgctgcattctggttaatttttttggatcttccagttcactgactctcttcagcaagtctaatctgctattagattcgtccactgagttttatattttaactgttattattgttcatttttagaattttgattgcatatttttaaaaatgtctagtcattctttataatttttactcactcctcatattgtcagacttctttttatttcattatacataataaacataatttatatttagtgtctctgttaactctaatagcttaagtctctgggtttgcttctgcaggttctcactcatggtgacctcttccattatctgttttatgctcactgcatactgcttattttctttggaactttatctttgaggatttgttgatgccttgttgaaggtgggttccttcagagacgatatacaattgtttttgccagaaacctgagaatacttccagactgggaccactgcaaactggatttcagagtgaggtttgttttagaccaaccaacttaaatgaatttggtctgcatccccatgtgaggatactttttctgctacgaactctcagaagagattttttttgttttctgtcgacagcaccaaggttggagatgggcaagtttcctgcagctgttggcaggctaggcattcgtttctagttctcttttacactgaggatatagctttttggtttccaactttaagggaaggtggcctattagacaacccaccttgggcaggtcctaggctttgtttcttgtccccatactctgtgagtcaaggtcaaggtcaaaagcccttaagacaaaagccagcttcactgctgtcagtatgtagaattcctgccattatttaaattttgacttgagcattttttacttcttgcaagacaatgaatgatttaagaagaaaaaattttttgtgcgtggtatcttattcggcattttttatttaatttcaagagcagcaatcaggatatctagtctgtcactttgctgctgtcttatttttcatttttcttttgtctaatttttccaagtaaaaatttaaagaatacaggaagatataaaggtaatgcttctctttgacttcagtccttaggagtaacacatagttaacataccaagcacactccattctatgtactttctttgcgttaattcatttcatctttcactaactctttgaggcaggctaatgttatgacctccagtttccagatgaggaaattgagacacagagaacttaagtaactcatccaccaagtgctggggctgggtttaaacttggcagtctggcttcggcacctttggtttgctttttatcaaggcactatccaggatcctcacactcactgtcaacaatgagtgcaaacttcttttctctgaacatataaacatatatatttgtcggggacatctgaaccagagtaactccatcttgaataggagctgtgtaaaatgaggctgaaacctaccgggctgcattcccagacggttaggcattctaaatcacagggtgacataagaggtaggcacaagctacaagatacagttcattaagaccttgctgataaaacagtttgcagtaaagaagctggccaaaccccaccaaaccaagatggcgaagagacttctttgttttggagaccagaaggatgacttctggtcgtcctcactgttacactcccaccagtgctatgacagtttacaaatgccatggcaacatcaggaagttaccctgcacggtctaaaaaggggaggcatgaataatccaccccttatttagcatgtaactaagaaataatcataaaaataagcaaccagcagcccttggggctgctctgcctgtggagtagccattctttattcctttactttcttaataaacttgctttcactttatggacttgccctgaattctttcttgcacaagatccaagaaccctctcttggggcctggatcgggatgcctttctggtaacacatccatactttttcctgtcctgctttttaactcactcattcaataagccttatttaaccccctttctatatgtcagagaagggctcagtatattcatgttctgaaggagtggctgtctctggagaaggacacacatgataataaagatgcaatttgctgtgtgctccagaggacttatgatgcattagaagcatgagcagacaggaggacatttacgcctgggcagggaggttgggggagtttctcagtggaggtgacatttgaatttgacctgaaaggttgagctggcatgcacaatctatggaaagctgtgtgcaacatactttctaggagaaggccacagcatatacagaagcccagagaagcaaaaatgaatggctatttataatctgtttcaacatttcattagatgcttatcaggagtcagtattgtatcttctatttcattgaatccccatggcacctgaccaggcacaagaaagctccttagtaactaccagctgattaacttaacgatccctttcttctttctattaagcaggcagagatgttgactctcagatgttgatgaagaaacaaggctagaggattgagtgaggaaagacaaggtctcacaggcctctgctggtgaagtgctcagagagaattctagctttcaaaggaatacatgaaagttgctgggaccagggctgccaaacacagagcaagagagaaataggctctccagaaagtaaacatttcccagatctgtgtttacagaccaccctgtggcctgtcttactggtgatataggacttccttagtttggattctctggcagtggaacccctgctgcctgaattatgactttcctcttcccatgcgggccccagcacaggacatatctctttccctctccctattgctcttacttattgctttttcagctacttaatctttcttaaagtgatttcttagaatctcagttttctccttctgaaataaggattgatagtatttactgggcagtgatgctgaacaagataatatgcatgaagggactagacaaattctggtgcatagcaggcacttaacacttgttcacattccccttgctatctttgtaacttccagaggccatgtggtctctttccagagattcagtgcctagctgaaacccagggtacccaggacacctggtgctactggctggatccagtgtcccggcgcccgtgctatccgtgctactggctggatccagggccaggcgcccaaagatactcaaaacagcaaaaggccaatgaggcagtggcgtcggcttaatagctgcttcaaggatggaaatactcagtttataacttaaatagtatttcatgggagaaagtaaattggagtagaattattcatccctgtagtccccacatgctaattccacagagacacttcagcatgatgattgctgaaactgcagaccggtaaatggggcactaacacccagcagctgcatattgggcctcctccagagtttgctggaatgaattgcttccttgcagggggaccttaagacctagctttcctgtggaggaggagcctgattcaccctctcccacctcccctatattctcccctctccatttcgcattctgtttcaccatcgttttgcaaatctcacttctaagaatggttgttagaggctcactagggacaccaggaactagtgggtcattgccagaggatgaagcagcacagattgtgaatgtcaggattgcacaggcggagaaaagcacctccccaagcaagaaggaagcacatgggtgtgggcaggggttggcggaacttgggccttgtagaaagaaacccaggcacatcatctcacagggcacagcccagcctcttcgtttccagagccctctgtacagccctcactccagccttccttcctgccctgtgctgtggctacttccttgggagacaggagtaagaagtccaaggggcttgaccctcacttcttcgtccttatcagctcacagcagaggacgtgctaaagacgtgcttattagtgcagtgtattaacaaaaacaaaaactcatctgccaagccacctgagtcagaaagaacagagttctagttttttgtttttctgccactgacaggtatgcacttttggcaaatcacctcttcattgagtcttagttttcttcttggtgaacagtttctgcagatgttctgtaaggtctgtgaacgagtctagggcctgaatgaaggtggaactgggctgccttccccctcctccagcaaagcctatcccctctgtgattcctgcctcatcttacagcatccctgaaccagcatctctcaaagtccccttactctcatcaaaaatggtcaaagtcataacaggcgctttaacttttccatcacacttgattattgtgaagatcaaataagacaaaagttaagaaattgtaattgttatgtgaggcattgttaggagtctcaccaaacagacatttaggcacaggaaacataggaagaaaggcaactcctgatggtgtatcaggccacattcagagctccaggaagatcacagacagctgggggtggatgatggcagagcagaatgcctggtagactacctaggagatctgtgatgcctacaactggcttaggccggggtctcaatcagatgacgatattctaattatcagtttgtgtggtctcttggcctgggcttcaaggagaaattgttaggtcaatggtatctcaccaggctagaagtagcttgagtcagggattggggttagcatgagtgttccttgtatactcatggtgcatgggacctcagtgagtatgtaggctgttaggatggggagggggattgaaggctgattgtttcagtcccctcactagacacatgacagatttcaaacaacacattccaggtctttacagagcataattaaaaggccatattttctaatagaaagaacagcttattttatttcacttctacaagttatttaaaattagtatttatgaaatagagtttttataaacagaatcctagacatataggtagagtggtcacgcatggtgcgccctccaatcccctgaatcttctaggtccaagataaaatatttcttagaaatccagctgtcggcagggcatggtgcctcatgcctttaatcccagcactttgggaggccaaggtgggcggatcacgaggtcaggagatcgagatcatcctggctaacacagtgaaaccccatctctactaacaacacaaaatcaaacttagctgggcgtggtggcgggcgactgtagtcccagctacttggaaggctgaggcaggagaatggcatgaacctgggaggcggagcttgcagtaagccaggatcacaccgctgccctccagcctgggcgacagagagagtctccgtctcaaaaaaaaaaaaaaaaaaaaaaaaaaaagaaaaaataaaagaaatccagctgtccaggaagactctttggcccctaggatcttccagtgcttgagatatttagaaagtctttgttgttcctatactcatctactttctctatactcttagatctttactgtgtttctgtatgatgggatctttggcataagacattccagagtattaagcatatagtggtaggcttcatcagtgctacccaggacctttttacatccaagacagcttaatagcttcaatggataaaacggcactgactcagaatgccagtagtgaggtgtactgggaaagataaacatttaccatcacattgtcccttgacgacaggtgaggaaactggggttcgtggatatgcagcagttacatagtagagatgggacccccacccatcagttctgcctgattcaaattccccactttgaaaggggtatgtgagtgttccatagtgcagaggcccagcaggaagacgggggactgggaatggctcagtcacagattttagcattgctgctggcagttatttatcttcaccacctcctatgtgccaggtgctgtgtaccatgagatagttctactttgggcagattaatgcttgaataaactcattgaaactttgctttcgacccatgaataaaactacctagcctggactcttgccttcttcccaaagaaggtggtggttactcaagtattatagaaatacactacagggctgaattggttctttccatgaagaagttccattttcttgactcgaaactgaggaaatgtttgaacaggcccatccaggtgggagtgtcacccagttgatgtggttgtgttctgatgaagctttggactgtggtatgttattacataccatggtaaacaagcttctgctgggtggtcgtcatgtcaaggactgggggatctgcctctcctggctctgtccttattggtcaaatatgtagtcttgatccatggctgggtggtagcctggagactcatctactcattcaatcattcattcattcattcattcaaatactgagtacctatcagagccaggcactatggcaggagctgggacacagaggaagagatcataaataccacccctcctctcaggaagctccagttttatgagagtgatgcatagcaattaactaaacctacaaatacctgtgcaattacaactgtggtaagtcctatgaaaaagaacggtcatgagaacatgcaacaaggggatctattttatttattataaaataaattaaatacataaaggatggatggatttgatctgctggccatagtttactgacctctgtactaaatagttaacatattaattaaggcttctaaaggaaagggaaatgaaattaacatttgtttaagcattcaatataggatatttaaccaatggggctgtccaggtatcatgtagactcttcatagctatcatttcttatgaactgctccatcagtcaggtattaccatccatattttacccctaagaaaacggaggcacaaagcaattcagtcatttgcctcaggtcacactgctagcaaggaatttgggcagaggaggaatctgaacaggcctctcaggctaggatcagagatcagacaggatttgaatccaggctatctgactttagcatctgcaattttttgattaaaatgagagcagcaaaggagaatctatgctggctggtttccccactgcagccatgaaggtatagctatgcacatggtcagctccgttggaacacgggcttagctgtcctttctttgctgctcagtggacagtggcatctttctatgcccttaagccactaggtctctacatagagaattaggaactgttgtataggaagtagaatatgtcagagctttattttcccaacatataaacatgtaaatcatcagtgttcaatattctggtaacaaagtaatctccttcctgttgagctgaagataagggatttgagaggctccgttggggagaaataaaaacccgacttgtaagtttatttgagacaaagccaaaatactaacatcgcattcagaagggggaaaacagtgaggggaggcgtgagaggagcactggaaagattagacatcaggtaatgcaacagccctggtcagcctctttagcaaaatagaaataaaaatgtagctcattaattctaggtgcacatccaggttgttaacggagagaggagacatagttcagaaatctgcttttctttcttttaaatgaacatgtttccattaaaatggaaattaaagcctcatcatatgaagcagtcattttctgggtactgtatgattatctctatctttcctggccacaatgagaatggaaatactcacattcatccattagcctttggaagttactactctgaaattctcaaagtagcctcctttccttagcattgaatgtagacagtatttttaggggtaggaggctgggtggatgtaagtacacaccttttcccactcaagttaattcagaaaggcaaggggctaatgaaaatgagggtggaatgttggaagtggcagaaaagttttgttttactttttgaaaaaaaagcaaaggcaggtaaatgtacatttggaaaaatgattttaaggaaatcaaatttgcctgcaaagtttacacaagcagatcatgtgaggcatgtgcttaaaatgagcagtggatggagttgcttttgtcttgggtagttcctgattcgtctgtttcaagaggtgctgtcagggagttcttgaaaaggctgttcctgggattctgccaaaccaaatactgtcatctccctctgaagactcaactcagggtggccccttaagaagccctccttgaggcctttctctaatcttctccatcatcattatctgttgaaattaaaatgcatcctgagggcatgctgcccagtggctttatatcttgtctgcacaatgagattgtaagctccttgaggaaaaggaccaggttgtgtgtgaattatgcattccttgtggtgtctagaataatatcaagttcagaagactcaggtatcacttgagatgtctctttctggcccctccaatggtctgaataaatctgactcaaactcccagtttaacagtcttgatgaagcccaaagccctatccatgatacgtgagaattcttattgtttttcttttgatgggtcccattgtgactagttcaaaatactggagactatgtcttttttccttctcattaacatggttacaaaactctctcttttataaacttccataaaagctggtgagtctcttaagaactgggtatttagagacctcaggaaggtctcattgggcaacacatataatcttttcagctctctctcttcctctcttatctccctctagtattacctcagaagctagaagccattcttcctttagtatttgggatcttctagctcctccagtttgcaaatccacatttatatggtctcagcagaacaaagccaactcataacaggacccaccatcctcagaaaatagctggagttttaaatgttaacttttccctattccattgaacagaacttgttgcctctccaagataaaaccctccctaatgaaaccgctttacaacacttacaactttatttaacagcagaaagctcaaagctgccatgcagagggaagctatgtagactctggaagccttgaagcttaggagcataggaattacagctctgtctggttggcttaaccacatccaggcatggaggcaaggaaaaaaaaaaaaactcaaagctttgtttggaggatggtactaggaaagaactaggaaactagtgagagaaggtaccaagctatgcctttgtccacccactattcaatttacaaatatttcttggtcctatatcaggcactccattgggtactaggaataaatacgcagatgaatgaggcatggctctttccccaaaaaggacttatatgtgctcaaaatgtgttacagaaatcccatgaggattcttggatattccaagagggtcaaatttcattgctctgtttttcatacctgggactgggctttagtagactctctctggtttcctgaagcttcataccccacatctgccctactgtgagagtccaaccccagggctctagctggcttctctcaactgttctacagttttctaggccacagcttgagatgtgacagaaaggagaaaggaaacatttattgcactctacttgatctttcatgtatactatttcaaatgattctgtgacaatctgctttcagccctcttttatggaggaggacacagagttcagggtagttaatgccttgcctaaagtaaaccaactggaggggaggcagtgagtggagaggagatgaagctcaatcctagagcctccagcctctgcttccaccttctggctagctcgccactaagtccatttaaggtgtcggctcacactttctgagtgttccattttctcattccttgtgccaattctcatgccaggattaaagttgccaaatatttaggtctcaggagaaggttgtttcacaatagcctctcttatcccctgggcctcctttctcaagaaggcagaaggttcgcagtaagtttggcaaacaagtctagtgtatgttgccaaaccagaaacaattattcctgtctctcttataagctcttcagttaagtctctgaaaatcaaatgtggtgggtaaaagcaatgaataataacgatagaaatacctaatccactggagggaagaggtcattcagttattcatgcgtttatgaacacatttttgagtgccaggaactgtgcaaggtgctggagacataagacagataagacaaataaggaatttacaggctgttagagagtaggatgtgctaaccagaggggagtgcaggttaccagaggagaggtcaggttaaccagctgggagggaaggttaccagaggagagggcaatcaaatcagagggtgtgtgttattaactcaaattcggctgattctcaaaatcatcccagttgttttataaatatatggattcctgggctctacccatggcctaatgaattggaatcttccagagccattatctatacttttaataagctccctcattgattgaaacaatcatgatagttgtggagtaaggtctcacagacacagtatagagaactttgctctgggtgcagggtggatgccaaggaggggtcagctgatgtgattctgggctttgtagagggggtaatatctgaagtgagccctcagaattacagacaagcaagttaggtgcatggggtgctaacaagggagggaggaaggcctcacctgagcagaggccctgtggtgtgagctgccacaatgaacccaggaggtttggttgggctatagtctgaggtgcaagcgaggacagggttagagaaaaggtagaaagcaggctggatcctgattggccttgctgatactgctaacaagtttgaattttactttttcttgacatattttcatttcaaaacatttttgaccatgttttcttttcaaaaacattactttagaacttctggaacaagatggaaatatgactcttccagctttagctcttgtcttccttccattgaaatgtccaaagaaatttataaaaaaagaaaacatcagggaaggatgccttcttcgaaccagaagtattggcactattttgcattggttaacactgatcgagcattactgtgtgtaggcattgtctgaaatgttcagcatctattagctaattgagttttcatggtattccataaaggaggtgctgtcactaagctgcactgatgagctattattgtcctcctgttacagatgaagaaactatggcacagggaagattactaactccaacggtctcatgactagtgatattaggttggtgcaaaataaaagcaaattggcaaaaaccgcaattacttttgcaccaacctaatagtatttggacccaaggagactggctctggagactggacgcttactcacagcattgtattgcctgatatattgtgaaatgtggtgctagtggcctggattgactgatgagcccactgcccccaattctgtgcatatgaaggaaaagttgattcaggcagtgggtgaacggggtacatagtgtaacctccctaacttccaagcgtgtagagggaatattctaatgctggtacatagaacaaaggaggaggatcaattcctcacctgcttagcagtgaagctccctgccacaggactgttttccttggtaattattttcctagtttccacgatcatggggaactttaacttggcacaaatgttcctaactttcagccgtagggtccagactccatggggccactactgggacaataagtgtggtcttacataagtatacagaagttcagtgggagctgatcgatggagctccctggactggagaggtgtgataattaaagcgtgggcacagcctgtgggcttctgagataaagtggacttcacgatagactggaaggaatccttcagcacaacatgagttctctttggtgcagatgcctttcactgtggcctcttcctgctcctcacagccaactatgttgccacaaactgaagctgcaaatttatctttttctttttcttggatataagatttgaataagcatccccacagcctcatagagaaatgatcctaacttggaaccatggacatacagtgctttctcaggaaagatggataaacagaaaaatcactgggtctatgaaatgatttagcagtttgaagaaactcatccgaagaatcaaagcaaatattttccactaaaagaagcttattccaaaaagtgagacataaccaaaaagaaaactgattcatattatcaatgagacttgagattcaagcactcattctatccacaactaacaaactgatatcagaaatattactgttaaacatttaaaaaattaaatgtgaatttatcttataaatttgtgaattcaaattttaaatttcaaatttttaactggaagtggtagcaatgaataacagattggatagcacagaaaatgacactgatgatttgaaagtccactttgaggagttccccaaaaaccaagaagcaaaagatagagatgaatataatatgtaaaatataagagatatgaggggtaggtttaggagataaaatagagtatagtaggaattttagaaagaaatacaataatcaatacatttggaatgtattaacacagcctgagcggaataagattttaagttaaatggatcctttctagaaaaagcattaccataaagatgattcactgttaatatcatttattgtatgattagatcaaaagagaaaaaatttataatcatttctttggatgactaaaagacatttaataaaaatgtatcatcacttctaatataagatagaaatagaataatatgtctttaattaaataaagtgtatatattttatttaatggtgaaaatatcttaaatgcaatgatgaaaaatagaagtggtctgtctgtgagtcagaaactatggtaatgaccattattattagtagtaacattgttctaggaatgcgagtcaatgcaactaagacaagaaaaaggaataagatataaatagtgtaaagtaggagataactataattattgtagatgatagcttatctaaaaaaccaaagaaaatcaactgaaaaacaagacaaattcaatttcagaatgctgctggtttcaaaacaaatgtgttaaagatcaataacttttctatataacagcatagccatttacataatataatggaaataagttcacaatggtcatgagagtatataatatctagacataaacacgtactgaaatatgtgggacttatatgaatgaaactgtcaaatattcctttactaaaagaaatagaaatttgagtaagcaaagaagcattacatgctgctgaatgggcagacctaatactgcactgttggaatactctagtacagtcacttttaggtgtgtggaacttgaggttcttattgcagatccaggtggagaggtgcagaaagtagatgggatatatattttgaattccgtagggagatttgaattacagatccagcgacagagatgtgggagttactattgtagagtggttggagccataagatctcccagaacactgtggggaatgcaaagagaaagtggccaaagatcaaatcctagagaatattaacattcacaaggaatgccaggacagagcgggcagtaaaggaggggtggtataagacataggaggaaggcataaaaccaggagagagaagaacctttttaaaattttttttctattttttcagatggtgtctctctctgtcgcccagtctggagtgcagtggcgaaatcttggctcactgcaacctccacgtcccaggttcaagcaattctcccatctcagcctcttgagtagctgggattacaggcatgtgccactatgcctggctaatttttgtatttttagtatacacagtgtttcaccatgttgaccaggctggtctcgaactcctgacctcaggcgatctgccagccttggccccccaaagtgctggaattacaggaatgagtcaccatgcccggccagcagcatcttagaaaccaaagaagacagcctcaaaaggtagggagtagcccatgtggtcatttgttacagaggaatcaggcaagataaggatgaagaagagtccgctgtatttggcttctaggagattactggtcacaatggcaagaatagctttaattcattgcagctgtgggggtaccaaagtggagatgaggattattgcgttacttgtgatgctaataaccatagaggagccagcacatgtggaatctactagttactgagtgaagtcaccaaaccctaatgagtctcaatttcctcatctataaaatagagttgcagttgcagtaaaaaagtgtgataatgactgtaaaatgctttttaaactataaaccactatacaaacagatggcattatttttggttctggtgatcttccaggcaatattttaacatgaaatgtgctaatgatgatggcactgaaataatggccttgaacaatttccccatcacttcttctgtggtcccagtgtttcattccaggatgggttctgtaacccttttaacacagaaacacaatctgctgtgtgcatttacactgatgcaaactaagctgctgggggaagtcaactgatctgaaatgttttgcaatactgtgcattgtttcagccatcagacggtgagtaggattcctgttccagtcaagttaggtggcagaatattttcctgtttgtctaagcagatgccagcacttaaataaacaccatgttccttcccagaatttagctggaaaatgcccccaccaaagagaaccctgagatgcttggcacatggccaaaaccagctaacatttcaattttcctttactcctattgtgtggccatagggctgatatttccccagaacctcagtgggaacattccagtgacaactaccaagtggtcataacataatgggtttatccccacattcctttcatcctttatccatccctataaagtgtatttttaaaaatttttattttactttaagttctgggatacacgtgcagaatgtgcaggttcatatatgcgtgccatggtggtttgctgcacctatcaacctgccatctaggttttaagacccgcatgtatcagctattcgttttaatgctcttgctcccctcctgctccacaggccccagcatgtgttgttcccctccctgtgtccatgtgttttcattgttcaactccaacttatgagtgagaaaatgcggtgtttggttttctgttcctgtgttagtttgttgaggatgatggctttcagcttcatccaagtccctgcaaaggacatgatctcattcctttttttttttttctgatacagagtctccctctgtaggccaggctggagtgcagtggtgcaatcttggctcactgcaacctctgcctccccaggttcaagcgattctcctgcctcagcctcaggagtagctgggagtacaggcatgtgccaccacacctggctaattttttgtatttttttagtagagatggggtttcaacgtgttagccaggatggtcttgatctcctgacctcatgatccacccatctcggcctcccaaagtgctgcgattacagttgtgagccaccacacctggccgatctcattccttttaatggctgcatagtattccatggtgtatatgtaccaccgttttttaatccagttatcattgatgggcatttgggttggttccatgtctttgctactgtaaatagtgctgcaataaacatacgtatgcatgtatctttatagtagaatgatttatattcctttgggtatatacccagtaatgagattgctgggtcaaatggtttttctagttctagatccttgaggaatcaccacactgtcttccacaacggttgaatcaatttacattcccaccaacaatgtaaaagcattcctatttctccacagcctctccagcatctgttgtttcttgattttttaataatcaccatcctgactgacctgagatggtatctcattgtggtttttgatttgcatttctctaatgatcaatgatgttaagctgtttttcatatgtttgttgactgcataaatgtcctcttttgagaagtgtttgtttatatcctttgcccactttttgatggagttgcttgtttttttcttgtaaatctgtttaagttccttgtaaattctggatattagacctttgtcagatgggtagattgcaaaaattttctcccattctgtaggttgcctgttcattctgatgatagtttcttttgctgtgcagaagctctttattttaattagatcccatttgtcaattgcagctttggttgcaattgcttttggtgttttcatcatgaaatctttgcccatgcctatgtcctgaatgatactgcctaggttttcttctagggtttttatggttttgggttttacatttaagtctttaatccatcttgagttattttttgtataaggtgtaaggaaggggtccagtttcaattctctgcatatggctagccagttttcccagcaccatttattagatagggaatcctttctccattgcttgtttttgtcaagtttgtcaaagatcagatagttttagatgtgtagtgttatttctgaggtccctgttctgttccattggtctatgtgtttgttttgctaccagtaccatgctgttttggttaccgtagccttgtagtatagtatgaagtcaggtagcatgatgcctccagccttgtagtatagtttgaagtcaggtagcatgatgcctccagcccttagctatacgggctcttttttggttccatatgaaatttaaagtatttttttctaattctgtgaagaatgtcaatggtagtttgatgggaatagaaacgaatctataaattactttgggcagtatgaccattttcacaatattgattcttcctacccatgaggatgggatgtttttccatttgtttgtgtcctctcatttccttgagcagtggtttgtagttctccttgaagagatcttttatgtcccttgttaactctattcctgggtatttgattctctttgtagcaattgtgaatgggagttcactcatgatttggctctctgcttgtctgttgttggtgtataggaacatttgtgatttttgcacattgattttgtatcctgggactttgctgaagttgcttgtcagcttaagcagtttttgggctgagatgttggggttttctaaatatacaatcatgtcatctgcgaacagagacaatttgacttcctcttttcctgcttgaataccctttatttctttctcttgcctgattgccctggccagaactttcaatactatgttgaataggagtggtgagagagggcatccttgtcttgtgccggttttcaaagggaatgtttccagtttttgcccattcagtatgatattagctgtgggtgtgtcataaatagctcttattattttgagatatgttccgtcaatacctagtttattgagagtttttaagcatgaagcggtgttgaattttatcaaaggccttttctgcatctattgagataatcatgagtttttgtcactggttccgtttatgtgatggattatgcttttattgatttgcatatgttgaaccagccttgcatcccagagatgaagctgacttgataatgatggataagctttttgatgtgctggtgaattcactacaaactctatttgttaagcattatgaaacaccagacactttgccaggaataaggcttaaaaaggtgaatgacattgaattgcccttgaaaagctcagaatttagtgaaaaagagaaacatgctataatttaattacaatttggtgaggtaggaactttaataagcatatgctctaatacggtttggctgtgtccccacgcaaatctcaacttgaattgtatctcccataatttccatatgttgggagggacccagggggaggtaattgaatcataggggcctgtctttcccatgcttttcttgtgatagtgaatgagtctcatgagatctgatgagtttatcaggggtttctgcttttgcttcttcctcattttcttttgctgccaccatatatgaagtggtaccagtgaatctcctgccatgattgtgaggcctccccagccatgtagaactgtaagtccaattaaacttctttttcttcccagtcttgggtatgttttttataagcagtgtgaaaacaaacaaatacaataaactggtaccagtagagtggggcattgctgaaaagatacctgaaaatgtggaagcgactttggaactgggtaacaggtagagattggaatagtttgggagggctcagaagaagacagaaaaatgtgggaaagtttggaacttcctagagacttgttgaatggttttgcccaaaatgttgatagcaatatggacaataaaatccaggctaaggtggtctcagatggagatgaggaacttgttgggaactggagcaaaggtgactcttgttatgttttagcaaagagattggtggcattttgcccctgccctagagatttgtggaactttgaacttgaaagagctgatttagggtatctggcagaagaaatttctaagcagcaaagtaatcaagaggtgacttggatgctgttaaaggcattcagttttataagggaagcagagcataaaagtttggaaaatttgtagtctgactatgcgatagaaaagaaaaactcattttctggggagaaattcaagctggctgcagaagtttgcataagtagcagggagcctaatgttaatccccaagaccatggggaaaatgtctccaggtcatgtcagagaccttcatggcagcccctccgatcacaggcccagaggcccagaaggaaaaagtgtttttgtggatctggcccagggtccctgtgctgtgtgtagcctagggacttggtgccctgtgtcccagccactccagctgtggctgaaaggggccaatgtacagcttgggctgtgacttcagaggatgcaagccccaagccttggcagcttccacatggtgttgagcctgcaggtgcacagaagtcaagaattgagatttgggaacctttgcctagatttaggaagacgtatggaagtacctggatgcccagtcaaaagtttgctgcaggggtggggccctcatggagaaactctgctagggcagtgtggaagggaaatgtggggttggagcccccacacagagttcctactgggacactgcctagtggagctgtgagaagagggccaccatcctccagaccccagaatagcagatgcaccaacagcttgcaccatgtacctggaaaaggctgtagacactcaacaccagcctgtgaaagtagctgggagggaggctgtaccctgcaaagccacaggcatggagctgcccaagaccatgggaacctacctcttgcatcactgtgacctcgatgtgagacctggagtcaaaggagatcattctggaactttaaaatttgactgcccattggatttcagacttgcatgagccctgtattgttttggccaatttctcccgtttggaatggctgtatttacccaatatctgtacccccattgtgtctaggcagtaactagcttgcttttgattttacaggatcataggtggaagggacttgtcttgcctcagatgagacttcggactgtgggttaatgggttaatgatgaaatgagttaagactttgggggactgttggaaatgcatgattggttttgaaatgtgagaacatgagatctgtagggcccaggggctgaatgatatggtttggctgtttccctacccaaacctcaatttgatttgtatctcccataattcccacgtgttgtgggaggaacccagggggaggtaattgaatcatgggggccagtgtttcccatgctgttctcatgatagtgaataagtctcatgagatctgatggttttatcaggggtttctgcttttgcttcttcctcattttcttttgccgctgccaagtaagaagtgtctttcacctccccccatgatcctgaggtctcctagccatgtggagctgtaagtccaattaaacttctttttcttcccagtctcagttatgtctttatcagaagtgtgaaaatggactaatacatgctccgaggctgagagttaaagtgtcagatgtctgattccttctaaatctgaaaacaggaagcttaacagttggtacatagtagatgctcaattaatgcttaataaatgattgataaatatcactaaacaggtgtatagatcacagctctcttagtcaccccaatgcattcccattagagaaattcactgctaaggggttgttccttaggagaatagactgtacacctcactctaccatttctagtgggtggatcaaaggctattaattccaaagaaagatggggccaagacttcttttttgtttgtttgtttggtattttgtgagacggagtctcattctgtcaccaggctggagtgcagtagcgcaatctcggctcactgcaacctctgcctcctgggttccagtgattctcctgtttcagtttcccgagtagtgggactacaggcgtgcaccaccacgcctggctaatttttgtattttttagtagagatggggtttcactatattggccaggctagtcttgaactcctgactttgtgatctgcccaccttggcctcccaaattgctgggattacaggcgtgagccactgcaccagcctaagacttcttataagagttcttttaggcaaaagctcagcagagggcagggtaggaacaatacacaatcaccttgactgagtctaacaagatgctatggcaagaaagcacaggaattgtcagaaatcttttctgaaggcatccaagcctcagtgggatgttatgaaagactgcttctcagaagatagtcctgacacctaagtgggtgactgagctagaaccagctactcacttgctgagaattattgacctctcttgtgaaatgtcaatattgactgactgcactctgagctgtgctgttaaaggcgttcagttttacaagggaagcagagcataaggtctgatgtctcttccagatctgatgacctaagatttgtttataggatcaggaaaaaaacccattaaaatacatctcttaattcttagagtattattgaaattgtgtacaacttggagagaagcaatggcaaaacttctgaaattcacctggcacattccctgtttccttccatgtggctgctaacccttttaagttgtgaagacagaggatccaggtggaccaaccagggatgcaaaagggaggaggtggttttaactcctgtgtgcaaggatttaattcctcacgtatcctctcttcctattcaagctaattccaggtcatcagtgtactctaagtattctaatcagattcattaaattttttttcctggaatcactgatggtgggcagcactattgagctttattcagggtgtgggactgaggtctctccatgaggccattcacttttgataaggaaactggcctcactataggagttcagtaaaggcccagcttgctggctcactgattaattgaagggcgggggtgtggggcttgctgtgcacaactaaagttcacttggatgcccccctcactgcccaaagcaatgcttggcctacaggaagctgagcctgctgctgccttcctcccggctcctggctccctcgggatctgaacactcagggtcatgctgttgctgcccaagcaggaaaatcctgtttctgaaaatcccaaacaacaaacagctcccctacagagctcatgggggagtagtcagaacctccagactgagcatgtcacaaggaaggactgctttgctgaagccactcactccgggagatttataattggaagtttggcccagggagataatcagccaagagcgcgcacgcacacacacacacacacacacacacacacacacacacacactctgaagaaacccagtggagattcagcactaacccaccacacacacacacacacacacacacacacacacacacactctctgaagaaacccagtggagattcagcactaacccagcacaggtgagtgagaaattacaacctgtcagccaatgagccatggtgattccctctgaagagggtttcccagctatcattccctttcatccccactgtaagttaggccctcgtgcatgttgcctggactgtggctggagtctcctaactgtcttgtcttctctgggttttctggccccaggtctctccctgtctatctaccctgcatccctgctgctgttggaagagtcccctaaaagaccttctccacagcactgcttagctcctggtactcccttatccctcctttcggcccatcctctgccactggcttccaagttcgcatttggcctgctccctacctcagtcctgggcagtgaggcaggaagctgcctttctcctccagatgagtctgtgctctgcctctctcctttgcgtctccaaattcacactgagcatgaacatctctgacctcaccttttcaaaccaaatgaaagggctgcataaggacaacttagtttattttggaaggctgttacactttgacctccatttaaaaaacaaacaaaaaaatctaaaaaccccaaaacgttgagggactgttcccaagccccagcatctttgccccatcctcaagccttccaggaccctctctccattcttgggattgcagctcctaacgtagttctcctcttcagctcaaggacaattctaactgtcttcttgcctggtatggcttaatgagcctcaagctcacttagcatcatctggatttaatttcctctcttgccgtgagcaaccttggctcatctttctgcctctcttctcctctcctctttttcctgtctccccctccctttgcttacatgcccttcttccccctttctctcctctctctatctctacctctctaatgtccacaagtgcctcacaactgccccattcaacccccacctgagtatcaccagctcttctggtccagctcacctgtaaaatctctattccatccagagaggccaccatctcctgttctaagggtcacatagctcagatacagacaaacaaggtcaggacaaccaccctcctgccttggaaaatcaccaattaccctccattattatatttcttgtgaagctacatttacattttatcatatccacataacaagagagagagttttaaaaaggagagtggtcaaatgtatgtcaagagacatagaaacacttagaataatgtagacagaacagatagctggagttattagaaggttattggagaccatcaaaaaggaatcaagatggtttaggatatattctattattctaactcaggattggtaaattatggcccataggccaaagctggcctgctgcctatttttttatatggcttctgagtgaagaacaatttttacatttttaaatgattgaaaaaaataaaaagaagactatttcacaagtaaaaattctatgaaattcaaatttcagtgtccataagttaagatatcctggaacacagtcacactatttgtttacatattgtctatggctgcttttgtgctataacacagagttgaatagtgtgacaaatatcatattgtgcatacaaattattgtggtgggtcctcgatatgataacaagtattcttgtaagcgatagaagaggagaagagacatacagaggacaaggccatgtcacaacaagtggagactggaattatgcagccacaagccaaggaacctctggaaccaccagaagctggaaatggcaggtaagaatttacccaagaggccgggcgcggtggctcatgcctgtaatcccagcactttgggaggccagggcgggcggatcacaaggtcaggagaccgagaccatccttaccaaaaatacaaaaaaaaaaaaaaaaaaattagccgggcatggtggcaggcccctgtggtcccagctactcaggaggctgaggcaggagaatggtgtgaacctgggaggcagagcttgcagtgagtggagatcatgccactgccctccagcctgggtaacagagcgagactccgtctcaaaaaaaaaaaaaaaaaaagaaagaattctacccaagagtgtctggaggcagcacagcccttccaacacctcgattttggacttctggtctacataacagtgagaaaataattttcttttgtttcaagccacccagtttgtggtaatttgttatagcagccctaggaaatgaatatactggtctttcatacaaagtttaccaacccctgtttcaatctgtctttctacattggatttgggtatgctcattagtgtctagttttcttctaaatgaagtaaagagatagtgaaatgtagggatacactgcatttccattaaaatgactaagagaatgagaaagaatgctcagcactatgaagctgacagctcttctcctcccatgatggagatgggagtcggggctgggtgctccatccatttctccaaaggactcatgtctcccatgcattccagctgctgacctggatcaatggttttcagaaacagaggctagaagggattatctcatcagcttgtattcaggtctgtggtagtggcagggcaggggttgggggattgataaggaggaggatgaagaaggaaaggcaccaccgtggagcaaactggtaactgagacttggaggaaagctagacccttctcctccaagtctaaacaaattccctttcctttcattttccttactaccatctgcccactgtagtcctcctcacccacctatggaagcaaggcttacccagtgactttgggtaggtactcaagcttctctttcctactctcccaaaagagaggactcaggtcctgacaaacaagcatcataacgacctacgaagacaggatttgacataggaaaatcagagcttgcattgttaagagttaagaagggggattgtacccaccttgttcctccacctgttcacaaacaatgtgtcaaagaaggggcaggtaagtggccaggcagccctgaaatagcctggggccaggactgtgacaaatactcactgggaacatcccccacctaagggttgaagtcaggaagaggagtgccctgtccttacactagatggaactgttcctctataaaaaagaagaagaaataaaacctgatacatgtattaatcttattcagggagatgtgggttttaagcaattcaaatatttcattctgttctttcagttctgcctactggccattatcaggaagatgtgggaaatagactgaaagaaaatcttctgattattgaaagagaatttacagcagcaaaacaatttgcagtgtttctacctagagacagggaagtaagagaatctgagtccaagtccccaccaaaaagagctttagtttagagcctgtttctcaagaaacttgcatatgcacacatgagtttgggaaattctcattattacctcataggttaggtctaaaccttattttaagactgagaaatggaaacctagctgtgtgaagaatgcatcaaagatcatagagatggttaagggcaaagagaatacaagactccaactatgacccaactgggtcctccaacactttttactatctttggatctgattcacttcgggtaaatgtctcctgagatcttcctatggacgaagatcgagcatttatcggaaaagcattactctaggcaactatgtaatcagtagaattttaatttgaccaagtggacatggagagatttccacagcttattaactttcccttgctctctgcctttttcccaggcagaaaatgcatattatgtattcccagtgtctggcttaataagagggattattataaaaggcagcaataggacatctattttctaaaatatcaaaaaatatgtatttattttgataaacagcaaaaattaaaatggtcctgggggaagagtgctctatcgcaggcctcaggcaaagttctaaccttagaatctgttagtagttagcagcagggttaaaagttgtttttatcagctctgggtgattgccatatattttcatcaattaatttttgttgaaatgcctgctgaatatgtgatgttgcatagggagacagctgaatgtttgcaacataatctaatttggcagctgggacctgaaagctgagtattcctcaaatcaatatgcccagcatcgcaaaggaagcagaactgaaaagagaggaatgggtggttgggtgagatgcttgcaatgtggtgatttagctggagttgggcctctgttccgaactcaaacggtcccatgtcccaggcctggctctgccaccaaccagctgtgcagcttccagcaagttatctcaacctcgagcatctgcttcttcatctgtaaatggagctagtaattgtaccaactttggaagactgttgtgttaagtgctttagaagtattatctcatttaattcttactacaaccactacctggtaaaataattttttattggtaccttttttttttaatgttttagagagataaacaatgtagctaattttgtaggaaaggccaaagtagctaattttgtaggggacctgatttttagtccagcttggctggcaactaattttaggtctgtaaaggttcagaaagtatatcctgaacacaagccctcctcagttacgttatttaaagtgttaaatactcaagccaaccgaaacacaaaccaaagtaaagaatttagataagaaagacatgtgaaaaggaggctactggtaagtacagaactcagttaaatgtaaataattatgaattaattgtattatctttttatttaaaaatctaataaattctgatttttctctccccaacttcctgtgatataactaagaaaaaacaaagagaaactagtttctgtaaaactggaaactccgagaattcctcagtgatatgccaggaaacaggaagaatttccactagccaaagttctgaggaagttacaggcaggaaaaaagataagggttaccatctttttttagtcaataaagctatgcccactctaggtactttccttagaaacatggagtcttcccagcagagaaaggaaagctagccccaatttgacttctagaataatagagccattttgaccacactttccctaatattagttactgttttcttgcactggcttgaggctacaattacccataaaatgttgtgtgactaggagtgcttatacctagagggtctgggtggcagttaaaaagagctgagtctgacagagtcgtagtgcattctgggagttatattgaatcctggagaaactatttaccgagcatttactacatgtcaatagaggtaccattcgctggatcaggcacataaagaattgggaagaaggtctgactctacaggaatcaataccactcatgaaaagataggcagtgggactggatatctccccatggcaatatattcacactacatacaagactttaagacagcaaaagatgggctggaaagtaagaatatcaaacaacacttgttcataagagaagtgaaccagcagagaaaagagaaaagaattgtaccagcagttatgtggatagccaggggaacaaaattaaaaacatacattgggagttttgggagtttacaggaaaatctctcctgagcagacctttgcacattaaagaatgagtaaatagaaaaaaaaatgaaattgatgacaatgaattatgagtacgtattataaaaggaggggaacataatgctcaaaaggcagaaaaaaacagttttgaaagaagatttataacaaataaatctttgtttgatttatttgttatgcaaataaatccaaaataaattagaaaatatggtagttttggactttaaaagctattcataacatggacactgtggaacagttctgactggaaatcaaaggaatagaagctgaaataaaaaggaacttgctggggacaaaaaggcaggaataaagaatgattgagatgagaaacaattctgaaagagttaaaaatgcagttacaaaatcggattcagcatcagaacaggtaaattgcaaaaaagcaaattagaaatgaaagaaccagctttagaagttgctccacaatgaaaaggaaaagaacaataagataaaaaataatggggaaatagggattcctggacaggagaactaaccaatttgaacagaagtaatgatttaagacataaccgaaaaaaaagttccttaatgaataaaagttgggatctgcttacactaagcaaaatcaatatacgtgagagaggggatacatatccagagatattctgatatattttcttatttcaatggtaaggaaagaattctaccagccatccaagaaggtaaacattttgcctataaaggaaaaatatcaggctgggctctaatcttctattataatgccagaaaataacagagccacatttacaaaattatgacatgagaaatcttatagagtgataattgtctacctaagttgtgctaaggtaacagaaagaacttctcatgaatataagagatcaggaagtatattcacaataccattcctggaaaaataaacaaaaaccaaaccccccaaaacaaacaaaaaccacactactcaaagacattagggataaacggttgagaagaatattaaaaaaggaaagctgtttactaaaagaattatggcaaatcttgcaaacatttaaattgaaaattaaagcttaataatagttataatatcattatgaggcttattacaaatgtcaaaaatagctctttaaagagaaaatatacagcataatatttaatagtaagaatatgagttaacattccataaaaaactgggacagtgagagaaaagaaaagggaattagaaatacatactaaaatgttaatctttcacagaggtacaatcaatacagttttatttttggcattgataggaagaaaagaatagtttcaagtaagttatttttaatgtaaactaccaggaaaataacaacagaatgcgcaactttcaagtcatgagacaaaacaaagtcaaagaaaatagtccatatagtaaaggaggtataaaaatgaaaacagtagagagaacaacaaatcacctaaaatagaagcagaagtagacaaagcatagtcactattacatgaaacattaatggttaaaacacttttatgaaacgaaaatgactctaaaaggtcagaagcatgtgaaaaaccatatggacttcctaaaaaaactattactcaggaaaagttacaaactaaaagatggaaaacttgtgtacaaatatggcttatggatattgagctatatcttctcatcagttctgtggagagaaacagatgggcaatattgagtctaggtcagtgaatgtatcaggtaatcactaatccagagggaatattagatgaatttgtcaaaattgaaggaggagaccaattgagatgctaacaagtattgactcttccaaaaaaaaaaaaaaaaaaaagaagtgagtctgtgttggggggaggggaaatgttggaaaccttccaattaatatcactcaggagcgtattgaaaatccatttgcagaatggaagccaaagaatgttctgaaagtgcattttagaataaaatgttattgctctgtgacacttacaaattcaaaagaatacagccatccaattaaaagtttacataatcagatttatgaaggtcaaaggcatcctaaagtattgcatgctttcattaccccacctaaatatttctttaagcaaaatggcagaatctttaaaaaatgtgttagaggcacacagtgttttgttccctaactaattctagccaatggccaatggttctggatctccaaatagtactggaagagtgccagtgccttcatatgaaagtttacaatatttagttcttctattttaggaaagagaaccttgggactagaataaaacatgccagtgaaaactgagaagctccagctagaagtgaaaaatgtatcaaaggaaatagatctatttgagttctgttttatctcagacatacttaattatatttcatgactttcttggttaggaacacagttccctgtaattgaaggtcaatatgatgatatttttagcaattttttgtgcagtattttttgtctgagagacactcaagattccacttttttctgcttaaaatctttttgcacattaattgtatattaccatttcattgaaagatagatgactcaaaaattttgttgatgtttcaaggttgttaaaattccatgctagaatcccagttacaatctgctatacttgagtatgaagaactatgcatttatcatgcgtggaagagactactgggcctacctcatattttccctgtcctggtcccataagagattatacttcccagtccgtttgcaactaggcaaggctgtatgaataagtctaaccaacaaaatgtgagtgaaagtgatgtgtgccacttcctggctaaggcagttaagagctgacatgacacttccacttccctcttacccagtcatggcaaacttggaagtcatgtgttgaaatgacagtgtcacagaatggagggagatttgatccctgagtcagcagatggtggagagtccccattgattcacaggagactttgggagagcaagcaccaaagtgctgtgctaactagagaagtcagggtttgtctatggcaacttttatcaatttttttacccttacataagcttttttgtgctttccttttgggctcaagttctttaggacctaagaatatttatttgccttgaatgaaaatgtgaatcagttcacagcagtacaaactcacagagtacaaactctaaaataaaggcatttacataagtcttaataataagttttgtgtttcataggcatatattctattaaatgcaattctaaatggattgcttggcagggcaaaggtaaatgttgccagatttcttataatttttaaagtacctctttatcagataaatgagaaaaaagttgaaatagaaacagtgaactctgaacttcttccctaatgacttattctacaaagttggtgcacaggtgtgttaaaaatatgatattcaacgttgttttcattagaagtattttatgacttattttgaagaaaataatcaattcaatataaaaatgtagatgtcttagtagtaagggaagagagcaagggagagagagagtgatttgtatcccaatattgcattattactcttcatggatttagtcatttgattcaatgaaatttaaaatgaatcatttaagtttcttcatgttagttaaccagtctatattttgcacaaaatgattcttctatttctttggagtatttcatgaagtgatataaaattatcacccttgtcttgaaaaaaaaaatctcctaaaaaagtaaacaaatggaggtacaaaaacaatcaagcaaatacaaactaagaaagcaggagtgggccgggtgcagtggttcacaactgtaatcccagcactttgggaggccgaggcggatggttcacgaggtcaggagatcaagaccatcctgcctaacatggtgaaaccccgtctctactaaaaatacaaaatattagccaggcgtggtggcgggcacctgtgatcccagctactcgggaggctgaggcaggagaatggcgtgaacccaggaggcagagcttgcagtgagctgagatcatgccactgcacttcagcctgggtgacagagcaagactccatcttaaaaaaaaaaaaaagaaaaagcaggaatgacaatatttatattgtacaaaataaaaataatagaaaaataattatgactaaatgaattatcttgtaagaattaaagacattatctaaaaaggtataacaataatgaaaattgaacgcagtacgtgaaatagataattttctggcaaaatacaaatgacccagtccaactgaagcataaactgataatctaaaaaggacaatagtcttggaagaaaatgaaaaataatctgttgaattactttgggctcaggcagtttgaaaggtaaacttaaaaaaaaaattatgtgataactattcctgtacaaagaaaagtaggtaaaagcactgaattgatttcatgaagcagagttaattttctatgactgtagttacactggctccgagtgctcctggaaggctctgtcatttgggctcctgtctcaccatgcccactgctaattggtctagctcaagccttaacttggcctctgcagaggttgctaacaatgctcagtcccaagttccattaacactttatgaaaataattagttataagaagccatagatagagcaaagtcaaggcatgaagttggatccatgaccatgtgacactgaacttgtcccaatccttctcctgaattttatgattcatcctattgtagaggatgtgtggaggggtggatgcatgggacccagcatgagcaggagcattggatcaaccacctgagcatccatgttagtcttactatcttcccaaagggcttatcagaagctagacgagggtttggattagattcctataacgaaaaccactaagacaaaatacctcagcataattggtcacaactcccacttctggccttaatccctttttgaacgaaagatctgctcactacaacctccttaattaaggatactcaagggacgatgcccacttggggctggtgtcccatcttccattcttttttattttattttactttatttttttgagacagagtctcgctctgtcacccaggctggagtgcagtggcgcgatctcggctcactgcaagctcgcctccagggttcacaccactctcctgcctcagcctcccgagtagctgggactacaggcaaccgccaccatgcccagctaattttttgtatttttagtagagaaggggtttcaccttgttaggcaggatggtctcaatctcctgacctcgtgatgcccctgcctcagcctcccaaagtgctgggattacaggcgggagccactgcgcctggccccatcttccattcttcaggtcagagcattgggccactggagtagtctgggaggggcctttgacttctctgcccctaaaagtgagttctcataaaatatggtgcgcccaggctaacgctggtacttattatggcaaatcctttagcttcaggtccctgctctttttgtcctccacttctgatatgacaaatgcccaacagtggaggcaggaagacagcccaccttctgtcagagcctactccccagctcatgtttctctgtccctccgttgtatagcaaactcttgccaagccttttggaatgactttttaacaagaaaagccccatactttaatgggccaattcaaacaactgacatctgttaaagaagcacacaaatatcctttaagtccttaacctttaattaaaaagtcatgcaaatgtacatttcctaaagggatacttttcccctcactgtgattagagaggagtgagactctaggtcaatccaaaacatgcaatcatataggcacattgctctattaaaacaaaaatgatttaatattaaaacattcattatttaataaaatgtcacatcattagtttaggggagaaaaacgtggtcatctggagacagactagaaattgattcagtaaaattcaacatccatttttgataaaatctcagaaactagcgcaaatcttttctttacaggatgaaaagtatcacaaatcaacaaacatagaatgatgaaattataaaagcattcccattatattttgaatgttcactatttaaatattaaacatattttaatgtgttttaatatgaaggctgctttaagaaattcaataaaatagtataatcaactgacttgaacattgcagaggatagtgatgaaaacttagtcgttggccaatcaatcagcgctccttctgtcttaccactcctcaaaccccactcccacacacctttattggtctttggccttggggctctcactgactcttccagagatagcaatcaatctggccaatagtctcaagatattttcaaagagagcaagagtgagagaatgagagcacagcaagtgagtgggctagagattgtgggcggctggggttgcaaaatgtaaaacttggaggctattagaggttacatcctcttttatttggttcaggttatctgaggaaaactgtttgttggaagagagaaggatggagcagacatacagagaagtgcagatataggaaagtctagttctaggtcatcctgagatgcagctgctgtgctgcatttgggttatagatgccttagtgttcttataataaaatgtgctttttgcttatggtagttctaaatgagctaataccaagaggcagttagttactaaatagatagcaaacattggatttttaaaaaatatgctcacaatagcaataaataagactacattatgataataaaaatatttttccacacttagcaacaaaaagataaacgacaggaacaatgaaactaaaatgtgcaggacatctgtatgagaaatacattcagtgcttgtcagaggtaaaatggaaaacttaaaaatggaaggcttataattgaaaggaaattaattatcccccaatgtttttatattttaatgcaattccaataaaatcacagtgaaattcttcttggaccatgacttaatgattctaaagttcacataggaaaataaactggcaaatgggcccaatagatcagaaacagagagtagcatggtgtatataggagggtggcagaaggtacctgcttgccttgtcagatatcagaataaagtcctaataatcaaaacattgtgatatcaacatgaggattgaaagatggatcaaacaactgtaataaaatgcctagaaacaaaccctactacttacaagaatttaatataaagtaccatgacattataaatttatggaaaagagaaacatttgccaagacatccttctggcacaattggtaaactatttggaaaaaaatttcattatctcactcatacaaaaactacaaggaaatagaggcaaatatcttggggtgacagagaacattttaaactaaaaatcagtagtgaacaaataaatgcttggtatattatgtagaactctgaatgtcaaaaagatctcagaaaaattaagaaaaaataaccaacttgaagtatatttgtatcttatagtaaaagagttaatattcttaacacagacaactcttacaaaccaatttaagaaataagccaataaattcaaatagaaaaatgataccattgttcactcatcaaattgtcaaatataaaaaaaaattgaagcagatacatggtccccagttgccaagaagcaaaattgggcattttcatacaccactggagaaagatgagttcagaactctcaagaagtaaattcaccaacatgtcaagagttttggtatttaaaaaaataatctttgacttgaaattccaattttagaagtttgccctgtggaaatactcagttttcacagactatgtagaagaatacttgttgtttattattttaaaaatctctaaacaaatgtcaaacaaaggagaattggttaaacgagctatgaccatataataatgggataggcagaatagtgcccctccactcccaaaagtttaaactctaatcccaggagtctgtgattatgttacctgacatggcacaaatgactttgcagatgtcattaagttaagggcctcgagataaggagatcatcctggttaattaggtctgcccaatctaatcaggtggggccttaaaaggcagagaatctttcttagctgtggtcctagagaggcatggtagcagctgaatggtcacaaagatgctgtgttactggctttgaagatggaggaagggggcagtgagccaaggaatgcctttggcctctagaagctagaaaaagcaaggaaacattcacccctacagtgtcaggaaagaacacagctctgccaacaccttgatttcagctcactgttgatctgtggcggacttctccccaactgtaagacaatacgtttgggttgtttcaagccattaaatttatggtaatttgttacagtagcaatggaaaactgatacaaatgggctgatttgctatcagtaattaaaaatcattttggttaagaacctatttagttacatgtaaaaagcggattacaaaattgtttaagtacagcagcctagttccaatgatgaaatgtgaatatagtagcaatgattatttctcggtgttgtaatcaccagagactttttcccctacttgattttctattttccaaaataaacacctcttccctttgtaatcagaaaaaaatacaaagaaatattaggtaaaatacactttaatctacatttctctaattattaaatcagaataacctaatttacaatcgctttatttcttaaggcaaatacttatttctaccttcccaaccctaattaaatctttatctaatactttctgaaaagtattattgtttttaataaaatataaatctctttcaaggcttattttcttaaatttcattttttggtttcaatttaattacatataacaactgagtggaaatcatgtttgatagattacaattctcataatcacttcttttgtttcgtttattcctcctttgagtcctcaattttgattcatttattcactagttatagtatgtctttgtattggtttagtttttatctaagaaaaggatgtgatggttctactctcaaaaccttgcatatctgagaatatctttcatgcaggaataacaatgagtaacaatgtggctaagtatataaggtcataatattttctgctaaaaattctatatggattttgctcaattactgtctgacatttattgccatctatcagaagactgagatcagaataatttttgtttccttttagttatcttttatttttcttgctaggatagatgaagacattttacaatttaaacctggaattcaaaattttaccataaagtgaaaggaatattaatgggtatagatttttttccattgatgttactttgaatatgtgagcccattttatattgattctggaaagtagattctgctcaggaaagttttattctattgtaattttatgatagctattcaacttatgctggtttctttttcaagaataactagtatgtggagttggatttctggcttgtctttttcataactaatgatttttctctccagttttcattttttcttcccctttcgtctctgttctagagcttgaatttttcttctacatgacaaatttgggttttctgtttccattactaccttcaatgcaattttatttccaaaattgcatttttagatttcttttgtttttttcctttctcttagccagacccttttgattttcttatcatctgacttttccatttgagagaggaaacattttcttgtatattcagagaacctaatgcagtgatacggtttggttgtgtccccacccaaatcccattttgaattgtagctttcataattgccacgtgtcatgttgggaactgttgggaggtaattgagtcatggggatgggtctttcccatgctgttcttgtgatagtgaataagtctcaggagatatgatggttttataaagaggaattcccctacataagctctcttgcctgttgccatgtaagacatgactttgctactcatttgtcttcagccaagattgtgaggcctccctagccatgtggaactgtgagtcaattaaacctctttcctttataaattacccaatcctgagtatgtctttattagcagcatgagaacagactaatacagtaaattggtactggtagagtggggtgctgctgtaaagatacctgaaaatgtggaagccactttggaactgggtaacaggcagcggttggaacagtttggagggctcagaagacaggaagatgtgggaaagtttggaacttcctagagacttgttgaatggctttgaccccaaaatgctgatggtgatatggacaataaagtccaggctgaggtggtctcagatggagatgaggaacttgctgggaactggagcaaaggtggctcttattatgttttagcaaagagactggcagcattttgcccttgccctagagatttgtggaactttgaacttgagagagatgatttagggcatctggcggaagaaatttctaagcagcaaagtgttcaagaggtgaattgggtactgttcaaaggattcagttttatgtagtcacaaagatatggtttggaattggaacttatgtttaaaagagaagcaggccataaaaattcagaaaatttgcagcctgatgatgcgatatgaggagaaattcaagccggctgcagaaatttgcataagtaatgaggagccaaatgttaatctccaggacaatggggaaaatgtctccagggcatgtcagaggtcttcactgcagcccctcccatcacaaaccaggaaacctaggaggaaaaaatggtttcatgggctgggccaggggccttgctgctttgtgcagtctctggagttggtgccctgtgttccagctgtggctaaaaggggccaaagtataactcaggccattgcttcagagggtgcaagccccatgccttggcagcttacatgtggtgttgggtctgtgggtgcacaaaagtcaagaattgatgtttgggaacctctgcctagatttcagaggatgtatgaaaatgcctggatgtccaggccgaggtgtgctgcaggggtgagccctcatagagaacctctactagggcagtacagagggaaatgtgggggtgatcccctactcagagttcccactggggcactgcctagtggagctgtcagaagagggccaccatccttcagaccccagagtagatccaccgaccgcttgcactatgtgcctggaaaagccacagacaatgccagcccatgaaagcagccaggagggggactgtaccctgcaaagccacaggagcagagctgcccaagaccatgggagccctcctcttgcatcagcgtgacctggatgtgagacgtggactttaagatttgactgccttgctggattttggacttgcatggggcctgtagcccttttgttttggccaatttctcccacttggaatgggtttatttacccaatgcctttatccccgttgtatctaggaagtaactaacttgcttttgattttacaggctcataggcagaagggacttgccttgtctcagatgagactttggactgtgtttttttgagctaatgttgaagtgagcgaagactttgggggaatattgggaaggcatgattggtttggaaatgtgaggatgtgagagggaccatgggtggaattcaggtatttcttcatagcagtatgaaaatggactaatgcatgcagatattttgattgttttctctttcttgtgctaaattattgaaaataatgccttttctaattcatcagaagagtgctctcctcattttgtgctatagaatctttcttacaaaccccattgttttcttgaatggagaaccagccaaactgggtttgacaaacaggggccattgaacatttgataactggcagaatcctttctagcatctaaatctggaaggcaccctgaacagccccatcccaagtttttgaacctagaaagtgttaattttgtgtacttttgctgaactgaggtggaaattactctttttgcaaatgcctgtttctctgtaagaaagaatagtcacataattctttaatctgagaaggaatatgagaaaaaaagttccttggacacttttcttttcgggctgtcccccgtctaggcagcccccttccatgtcttccctaaggggcctgaacacacatctcagatgcctgagatgtgtgttccctgtcccttccctgtcttctccttgctctgcagtaccctagaagttgtagctccccaggacaagaggctcttaagtgggaaagagaatggaacgaatatattcttctggtcacctcagaaaattatgacttgccccagcatctgcaatacctgcttcctcttattaacagcagaaagtacttgcattcgtttgaaaaatagaaatttatttatagttttggaggctagaagtccaaggtccagaaattggcagagttggttccttcagagggttatgcagggaaggatttattcagatctttttccttggcttgcagatggccaccttctccccgtatctcttcatattgcctttcctctatgtgtccaaacttccttttttttaaaatcaggatactggtcatactgaactggtgcctaccctaatgatctcattttaacttattacttctaaaaatcctatcagcaaataaggccacattctgagacactggggattagaacttcaacttatgaatcttggggtggggggtcaggaacggacacaattcaacccataacagtgctggcaaatgactcctccatctttaatcctggaggaggtgcaactccaggtaaggggtcaggggatggataggcttggtaaacttcttgcaatccagtaaaaattgcccccattcactggtataaattcagctgttaaccttagtacccaatgcagttgtaggtttccataattttttctactttgctgagtattatattgcaagaataaagcctgactgccagattaatctggaagttccagtcatgaaatattcgtttataaataagtgatttttttgagcctgctttactgtaactatactatacctcatcactgccaattgtattaatgacttttggggttatttatcaaaccatgaataataattaggggtcattttccatcaaggaagttggcttttggtctacttgacaaataaatcttgttagactaaagaagaaacatcaaaaatgaaggaagaatggaaatgactgaaggaatttagcagctgccatctctacaatgaagctggggaaaaaggaggaaacagctccttccctaaccttcctgcaggagtgagcctccaaccaatcctaaattgaagttttgtctaattacactacaattatctactcttttaacttgaaagtatattcatcatacttttccctcactagaaagaacatcctttgacttggtaatgatcaagctacattgttaagtcaagagaaaggcagaaatgagatcttcctgttcttatgcaaagaacagttctgtaatgaggtgtcttactctgctccattttttctgagccacttggccttcccagaggacagacagcctgatgtgctaaacaccagtctccctggtgagggctaattacaacactgcagctcaggaacaaaacaatcattctctttgcttcactcctcacacactctcctgcctcactcccaaaacccaggaacttttcctgacttggctcccaatctgccattaccatctctgaattctgtggtcctttctcttgatatgataccccaaatcccccactgaaccctcaagtagtatcattgttatgacatccactgcaacactgaagactattctgtattgttttctagtattttctactgaaagcacttgctaagcatacaacacctttgcagatagagtagtctcctcttacctgcaggggttacgttccaagacccccagcagatgcctgaaaccatggatggtactgaaccctatatatatagactaaattatgtttttttgatctgataaccaacagggctattaagtgactaacggtaggtagcatagacagtagatacactgggacaaagtgatgatttacgtcctgggtgggctggagtgggacagtgtgaaacttcatcaggctactcaaaatggtgtgcaaagtaaaactcatgaattgtttatttgtaaaattttccatttaatattttcaaaccctggttgaccgtgggtaactgaaactgcagaaatggaaaccgtggataaggggggactattgtaatagcaaatggttgctgacagaggaagaggtgtaatgtaaaagaagtttctttttctcctctcttcttaatccatagcaatggagagtgaaaggagaatcacttctatttccatttcaattgtatcaattctccctggtgagaatttgcataatggttggggatttcattaaagatatctccctaggaaactagatagctatggattttgatgacttctattaccaaagagagattctgttctcaggcccaatttcaggggcagaggatgatgaggggctgaacacaggcttttaagaaatcaattcaggagtctttatagattgatcagaatcccaatagtttattgatttttactctgaaataatgtctcctttgaggctactgagttccaagtaactaaaggccaatgaaagtatctttgacactgtttctagctcacaaaagtcctcagatatgaattccctcaaatccctttgcttctagatggtgagtacttccttttgcaaattggatatttgtgggaagtgtgttttgtcacaatgactcaggggagctcctggcattttgttgtgggaaccaggaacgctagatgtcctgcagtgagtggtattggtcctgcacaaggaaatattgtcccacgccccaaatgatttttgaatgtccctccagatattcatgcaggtgaaaaatcttataattacccaaacctagaacttatctctgattttaatataaataaagtgaatagttcctattgctgctcaaaacgacacaaatttcttcacacagttctggggttcagaaatccaaagtgagttttgctggcttaaaataaagatgtccttgcagagactctaggagaataactttgacccttcttttttcagattctagaggctgcctttatttctttgctcatggccttttgctctgttttcaaagccagcagcatagcatcttcaaatctctctctgactttgaccctcccgctgactttgatcctcctccttcccactttcactgcgaggctgcttgtgattacattgagcccacccagaatgcccagggaaacttccctatctcaatatccttagcttaatcacatctgtaaagtcctctgtgccgtgtaaagtgacatagtcacacattctagggattacaatgtagacatccttgggaaggcattattctgcctatcatagaaaacatacattttgaactttgaaaacagatatcctggattttctcagaagctaactaccatatacatcaaagaagattttattttcttttattgccgataattaatcctcatttcagaaatcacattactgactgtagcatggctcactatgtttgagctgtccaaaaaaaaaaaaaaaaaaaaggaaacagaaaaaagaaaccccactcttgtatctgccatccattgctactacattctttttattttaaataacagtgtaagcctagcagattcatcctctatcctaatgttgtgtgtctgatgttcaatttccatattgaaaagcagagtattttattataaactgcttttttctcattctcttttataatacagttaggacattatattgatttttttccttgaaattgcatatataggtagattgtaatatctataaatttttttcattatagtaaaggagacattatacatttttttttttttaagtacagcattaagtcgtctatgggcatctcagattccaggttcctctctcggttggagagtcttctccacgccaacactatgcattgtgttttactcccttcaatctcctttaaaacttcaatctcctttaaaactcctctgagcctatccttgctgagctcatcaagcaattccctcataatagattctatagttctggtggcattccactccccaaatggactttcccagaagatttctgggggaggccgctagccatctgagactcttcatctagactgctgttccacagcaggactttggggactctgatggagccccaagtactccccacaaggcctctaccttgtcctccctgcaccacctgcctcatcacaagatgtctcagtgtctaatgtcaagtaggaaactctaattaggaagatgggccttcctcttaatgacccccaggaccaatctcatcattccttacttccctgaccaccaccagaggtctgggcttctcagtgaacagtgactaggcttttatctccaatatggctccaaacattttcctacactgatgtagtctcctgctctccctgacccccaaggaacactgtcttcagcaaaatcctcaacctcttcttcaaagatttccttcaccttttcactgcctcaaacttggctgttccaggaaaccacttccaacactgcagtcacctcagatggtggctgttcctcctccacagtccacccaccacagagccggcaccaggagtacttgctgccccccaccaccacttccagaattttactctgtctttctctttcagaccccaccccctctgaagcacttgactacaccatctgcctgctgcaccatgttgaagccatttcttgactcatttattgctcattccctctcgttcgttggaccttttcacccctggctcattgtcttcatccccaccactgttcctgtcttcacgtttggtgacaatagtatccacatacatgattaattcaactccctgactcagtttcttgtcgtcctcacttccaatatagttttctccacttgcctctagccttccactttcatgttaaatcattatctggactttgttatcaacaataactacatcattttcaaaatgtctattttaagcctctcactgtctgaccattgcctcctgtctttccagttcatgcactttttagttgaagtccaacaattcttaatactcatcaggatctctagcccattgattgcaccacttttatcttctatctcctacccacgtccttgcttctttgtttacctcacttagattccacccaccaccctacagtcactcctcacatatgcccttgactccactttactcctctcacaaaaccccaatgctaataattttctgcctgctctatgcctacatgacaggaagccatacgttatgttgactgatttctaaattctcccattaattcacaaatctcaaggcatgcttcaacattgcttgacaatccccaaatatttctgtagtcacttcaccctccagctccacaacatgacgatttcacttttcctctcctctcaacctctaacacctccttcctcaccttcgtctatgaccttattttttatttctttgggaaaacagaagcaataaaaatgagctgtcattttatcataaaatctaccagtctatcttcacctttacccatatgtccaccttccctctagatccagaagatctacttcattttgaaggacaacctggacccatatgctcacttaaaacctttgctcctacattcattcatccctcactagcatcatacatttctttcaatttctctctttttttttttttgagacagagtttcgctctttgttgcccaggctggagtgcagtggtgtcatctcggctcactgcaacctctgcctcctgggttcaagcgattctcctgtctcagcctcccaagtagctgggattgcaggcaccctccaccacgcctggctaatttttgtatttttagtagagacggggtttcaccatgttggccaggctggtctcaaactcctgacctcaggtgatctgcccgcctcagcctcccaaagtgctgggattacaggcgtgagccactgcacctgacaatttccccattcttatttctattcaaacatgctacaatacctttccccattgaaaaaaaaacaactcccttaaatcaatgacctttctacctaatacactttctcttttctcccacttataactccacttctcccctcacattcttctgttagctcaccactttaatgaagccactcttgagtaagtaatgatctcgtcttgtcaaatctagtggtccagtcttggtcctcattttacttaacttctcagcagtttatgacacgtaggtacttccttcttcccgaaatgctttcttatttaacttccagaataccttacctattagttctcttaactcactggctattattccttgttggtcatatttgccagttccatctcatcgtcctgattttctaaatttagagttcgccagggctcaggcagggaaaatgtctctatctccctctttctcctgggtgattgtatacagtcctatggttttagttatatgtcaataagtcccacatctgtatcccagacattattgctctcctgaactccaggtttaaaaatcaactgcttattcatgaagtatctctacttgtctatctactgcctatctcaaacttcctgggccaaaatgactcctcatttctgttcttgaacctatttcttttccagtcttccccatctctgtaaatgaaatcagcattctcccagttgctcagcatcaaacctagcagtcattcttgactgtgcttttttctcttctatttcacatatatcccatcaacaaatcctttgactttactttcaaaatgtctcccaaatctgatcccttctcaccatgtctaccaccagaccctggttttagctaccataatctctttcctggggtcaccacaggagagctcctaactggtcttcctgcttccacttttggccccttactgtccatttgccacacatcagccaaatgatcttttaaaactgtagataagatcatgtcccttccctgctaataatcctcagattgcttcttatcatgcatagaatgaaatccaagcttatcttgtggtggtagagaattttaatgctcactaaatattcataggcttgcccacattttccagagcccttgaagttgggcctggccatgtgactagctcttggtaatggactatgaagagaagtgatgtgtattgcttctggactgggacaggttaaacctccttgcaattctcagttctttcctccttaaatgtagcaaccaaggagctcaggttgagatggctgagccacatgatggaaacaacctgcaaccaagtaatattttcagggaggttctcaggacagaaattgtgcctacactagagtagacttagactgagtgatgaataaactgcatgataaagccattgagatttgggggtttgcctgttactccagcatatcatagcctgccctgactaataattgtggtctatatggccttcttctctagcctctaccctgactcactccaatcctgactcactcaggctttattgccaatatcattcctgctttggggtcttttattctagctgtcccttctacctggaaagtccttcactaagatcatcacatggcaggttccaggtctttgttcaagtaccatctcttcagaaaagccttctgtaatctccctgttttaaatggcttccttctacttcccatgactctctatcctcttacccttgtcggtactcaaaattacatattttatagtttattgcttggtgtctatcactctaaatggagaataagggctcttattgttctttgttgtatccttagaatctagaacaatactggcatatagttgatgtgtgtattaattacattaatggtcccaactatttatccctctctgtatacttgcccttttctatgagtgtttgcagttcttgtcactgaagaggtagaatatagctcccctacattaaatctggtctggttgtagcacttgctttggccagtgggaggtattagatgtgacacaagcatagacttgagaaggtgcttgcatgtgtctgtgtgccttttgcacttttcaaatccaaaattatcctgctctgataggataaccatgacagcataccttagctagcctgtggaagcatgaattgcatgtggagcagagctgagtggccccagtcatccctccagggcccagattatatcagttggcagctggttggccccaggcatgtgagtgagcccagacaagattcagacaagcacagcccaaattcactaaatgctccaaactaatgaactaaataatagttcattgtatactgctgaggtcatgtggttgtttgttacacaacattattgtggcaatatataactgatacagcagaggctcaataaataactgttgaatttctacagtggatattgcagacattttacagtgaatatgtagacgctcttttacaacctgctccatgttcctgatttaaccatctgtctagcagtctgccaagttggtaaactgggagaagctttaacttcttccacattctcatttctaactctttactctcttgcaaacatctaatggcctactaaatcttccaattccaccctcaaatctctggaatcttgtttccccagtcctatgttttgaataatattttgcctccatatcataataacttcctatttggaatcattaccaattgtttcttccccactcttcaacattctcccactcctcttaattttattagcctcaaaaacaaatatgaatttaaaaattgagggatcattttgaaaagcttctttccaaaatttcctttaaaaacatctagaaaataatttaaaaagaaaaaaaaggaaatataatctgagcaggttcattaaggggaaaaaaaaatgacaaagaaaacatactccagaccacgggttcttaactgtctgatgttaaaattaatttatctttccccatataaaatgagatattagaattatttttaaaaaccatagtggatttaacattatccctatggtcatgtcactcattcatttgctcttctgagtatgaaataaacgatgaattcatagtgtcaaattccaataatgctcagactatctagttgaactccagcctgcagtgagtttgttactgaggccccattaatagttggggtggtaatgaattaccatagtgcttataagttgtgattttatgtttcttccctttttgttttagttttattcatggataaatttttaatgtaagagatggaaagtataaataaaaagtatttgatcctccaaggagtcatgcttcctcctgcccagggttttcataaatgcagttaacttgtttacaattctttcctcccaacctgacctcactcctcttaattagctaagactatatttggttacaaataacagaacgtctgtttatcaagcgctcaaagaactagcggtttcattgcttttcttaacaagaagcccagagctagtcagtttagagctggtctgtggatcagtgatgtactcaagggaattccaggtactttctaactttctgatccacaacccttagcttaggctaaggattagacagggcttgttctcatagatgaaacctggtgttcttctccaggcctctcgcctgtgtttcagacagcaagaaaggggaaagctaagagtgaaaaagcatttctccttgtggctgttgcctttttattcaggaagagacgctcaacctagggacttctcctgtacccccattgccccaaaatttctctcatggcctgtgctccctgcaaggaaggctgggatgtggacagcatcactagtaggggactgcaaagggcaggcaactgtaaatggcttgtatgtggtcaatctatagtatctgccacaatacccacccctgacactctcaccctgaactcccgctcttcctttagatctcagccctgagccatactgacagtgtgaattttcatatacagccatgcgccacaaaacaatgtttcagtcaataacagactaagtatatgatggtgcttccatgagtttataatggagctgaaagattgttattgcctagtgatgtcgtagcacaacacattaccttttctatgggttggtatgtttggatagacaaaaacttaccattgtgttccaaattgcctacagtatttagtacaattacatgctgtacaggtttgtagtcaaggagtaacagggtattctatatatagcccaagtgtatcgtaggctataccatctagatttgtgtaagttcttacacattgttcatgatgtttgcacaatgacaaaatcacccaatgacgcatttctcagaatgtatccccattgttaagcgatgtatttctgtactctcatagcattaatgttctttactagctcttaagacagtttaaaattatacaatgatgtgaataatcattggattaatgtcttattaatacttatttctcccaattgactgtaagctcctgaagggcagaaatcatgtttgattcttgccattgtatccctgaatctcaggtatatatgatgtaggagctctataaatatttagatctacatttacaagcatgagtgtgttcaatgtcagtagaagataacaataaagcaaagtcatgataaaaagaaaatgtgccaaacttgacttgtattaaaaataacgttagaagccaataacttacatgcaataagaatacattagaggcacaaagtaagatttatttctatttcttcttcaatagtatctacttgcttttcttactgtatagtttatgggaagggagggcctcgaaaaaatgaaacttagtgttttaaaagaaaagtttaatttttaaaaattgcagcgtttatctatgttttttctctaaaaaggttaattattgagatccttaaatcaacagctatattaatcacagtcttgtcaaatgtcttacaaaatgcacagccaagtgaaaaagtctgcattgctatactgtgcttatctgttacgtttccctgggttttgtcaacatctgtgcccatgaggatgtgtctcctggggaaaccgtgtactacggcaggaaaaagatggagtaccgaagttctgctcactgagaaccgctgcagtagtccctcccctgctctgtccgaagctggcttttgccttgatcaccccaggaaggagtacacggctgggtttctttctctgcgtttatatcattttctggtagagcccttaagctgagggagtaaaatcctcaaactactgtgaagactccattcccattagttttctgtgtcaataacgtattgtgttattacttttattcttttgcttcacctgaaaggctcagcaaaagtcctgtgctactgcatgatgagtaaacagagaaaaataaggaatttatattatttaggaaactggttggaagaaaagcttctcactgaagttcgcttatttcagccaacagaattttagaaaacagttatttcacttattcatggccctaaacctaaacttgaaaagacagcattaaaaaattaaagcttatgtaagttgtattttatagcaaggatgcaaaaacgtaaatgaaatgttagtaagtaaatctaatagtgtgctaaaaggacaaagcacaagaacaggtattgtttattctaggagttctagaacagttgaagattaggaaagtaggcaatatgaaaaaatgtattaatagatggcaaaaacacaattggcaaattaagtatctagatttgattaaatctcttagtaaactagaaattaaatgatgtaattttaaaatgtctgtcttaagccaatgggcaacatatttaacaattatattaagagaaacattaccatcacaggttaaaaaaaaaggtgcttatgatcatgagttttaattaacttgttctaaaagatctaataaaaaaagtaaaggacacagacactagatgtaagattaaagctgatgatgatttatagactatgccattatctgaggaaaacctgagaaaaaaaaccagaaaaatcattagaacttcaactgaattacaggacttattaagatagctggtttcaaaataactattaaaaaataaatagccttctagtacaccaataataatccattagaaaaaaaaccaaggggaaatattgtattttcattagcaaccaaaaaagttaaatttatatatataatttatatacaacatatgtggtaatatgatatatattaggttctatattatgtattatgcaatatataataaaactttttaaaaaatgtgtgggatctatagaagaaaaatgtaaaaaactgtaaagaaatcatattaaaagctcgactacatagactatgcatcatgttcatacactgaaaaaaaacttgatatgctaataattctttccaaagctaatttctaaatttaatgcatctattgtatttccagtaaaaatttcaacaggacttatccataagggtgttttagattatgaatccagaatttatcaggaagcatatatgcatgttgatacgattaaagaaatagtcaacaaagtagatagatcagagaaagcctaaatataaataaaattcattgtaggacaaaagtaatatttctaatctgtagggaaatgatcaatcaataaatggtgtttgaacaataggataaacttatatggcatttaaaaaagaggtaatctaattatattaaattattggagtggaatattaaacaacaactaaattataaaagtacagtaaatgaaattatttatgcatatttgcctacttttgagttgaggaaggtctttttatgcataataacaaagagaaagcacaaaagaaaaggcagatagatataacaacataaaataatataaaataatcactgaaaaagaaatgaacattttaacctgaaatataaaaaatttttatatcacatgaccatcaaaaggttatagcctttaatatagcctcaacctacagtttctgcaattcaatatggaatttaaaaattaagatttaaatttaaagctctattaattcacaaatacaaaggaataacaaatatattaaaatatactcactagtaagaagtgcaaacataactaacattttaatcttttaaattggaaaagatttttgtaaaattgttaggaatatggataaaggaacactccaatatgttggatctatatattctgtttcacactgcaaattactaaagctttctgaagagtggcttaacagaatgaagcaaaaggcttaagatggctaacactctgaacaaacaacttttcttctaagaatttatcctaataatcatccatgtgcgctagttttgctaaaacacattgatgacaaattatatgttgtagcaaaatctcaaaacaccccccagggtttaagcatgagggattatttaaattacgatactttgtaaccacttggcatgatcttatagaataaagtttattacataaaatatatctttattatgtaaaagaaaaataaaattgtatatgctataggactataattatgaagattctatgcatagaaagaaagtcttgggccaggcactgtggctcacgcctgtaatcccagcactttgggaggctgaggcgggcggatcacgaggtcaagagatcaacatcatcctggctaacatggtgaaactccgtctctactaaaaatacaaaaattagctgggtttggtggctcgcgcctgtaatcccagctactcgggaggctgaggcaggagaaatgcttgaacctgggaggcggaagttgcagtgagctgagatcgtgccattttactccaccctgggcaacacagcaagactctgtctcaaaaaaaaaaaaaaaaaaaaagaaagaaagtcttggcatgaaataattcctaagaattgacaatagtggtgcttaggcagtgagatgagcgttgattttacatttatttttcttcaaactatttttttgtaagttgctaattctctttaataagtgtgtaatattttacgatttatttataatttaactatattaaactaaatttaaactaaaatgtgatcagaaaaacattggagttgtgcaggtaatattcaatagtaagttatttttcttaaaaaaaaaaaaggtggcttaagttcttacctaaatgaacagcctcaagaatcctttcaggatccttccagactcatctgcttaatcagaatgttagtaatttgcatttttttctattgctgtactcatcaactgttttatatacagcagtttttgttttcatctgtttcatctccatttttcagtcattgacatttattgaagctgtgctattttcaaaatgctgaggaagtattgggaggagatgaagcaaggaatttttatccaggtgtacagagaaaaaaagaaaggaaagatgcagacaaagaaaaaaggatgaaaacttccagatgacatgtgggtccagacagaccctggcagaaagcccagctcttggaaaactggccctcgccccaggatttgtaaacagcacaaattcactgatgaagatgcaggagaggtgaagaatctgctttggccatctcagcagcactgccctgctgcccttaaccccaacccactggactggctgagaatatattccacagtcccttcttaacatccttccaggttgtaaagatattacatatttatcaaaacaattagtgacttataagaagtctgaagaagacagaagcaaatacgcaaacaaatgcagagtgcagtagcacctcagggcagagataattctgcctgtgacaggaaaagatctttcaacagcagtttgacagctcctggtgacagatccccaccacagtatcctccagcagaccccttggtggtatacctgggactattttttgaaagccaaactctggatacttctgtattacctaaactccggcacctcttacattccacattggcacagttccgaggtctaagtttgttttaattctctacaatctttcctgttcaaggagtaggtaactagaatgaacacattcccattttaagatacaaatgggaccttggaggtagaaagacgtccatattgtttgtaccgtagtgtgattttaattagctgctcttctcttggttcaactcaacttactaaattggattggctgtgaagggaatggagcagtaatttgggttcatgcatttgtgaagcaggattggggagtgcctcaatgcagactgtagctggttataacattattggagggaaaccaacaaaaacgagggaaatagtatctgcgccttctttgcattctgcctaaagtcttaggatcacagtgtcctaattggatcattgaaaacctatgatggctttgatttggcaggtaatctagctgaatctttaacacattaacttccagacccctcatcattccagctgggaagagaaaagaacttcaggaacaaattttaaaaatgaaatttgttaaatcatgaaaattccaatgaagttttctcttttatcttcctagctcatgtttgaagagcccagctaagttgttgagctaactcgtatttcaagctcagggctgcattcattttggttcccatcacgaattctaaaggcatttgaaatttccccttggctccctgggactatttagaagagtatctcagttgtttgtagggttttcttttgtttaaacattttcagagtcagacaaattcttttatgaacacatattcactattcaagtggatgtttctctacagtaaaataaaattaataaatcatacaaagtgggtatttaagcttatgctcctaatctcctcacgtgccactcaatgtgcacatgaggtttttaaaaattagtgtctcaattatattctatgatagagagaacagaggtgttgctagcatgactgctcagcactctcccctcatgagctcaggcagctgtgtgatttgtgaaggtggctgctcatcagtccatctgtggcttagggcactgggctgagctgtaaaggcagagtatcattacagattattttttattatctgaaataatggcaataaagtggaagtgaaggtgaagaaacccagcactcctagagctatgaaaaagccataaggctctggcctcaaggggaaacccagttaatttaaagaaggaatctctaatcatccagttggaggattcaagggtactaggtggttttcaggctccaggaagaaggtccctgccactgatgacctcatgccaagaggaaagaaagctgctctgtagaccttctttataagagtacaggttggaaccatactaagagcctggctttgttaaacccaacacatactacaatatttttgatgatttatgtgggtaaataggatacatccagaaaaaatctggcacatatttttcatgacctcagaatctcaaaaaggcaactttaggaccaggtcttgtggtgattcttttttctttttggtcatttttttcatgtcaataaaaaggtaaaatgtagaatgtagttaacgttaatcaggtagataaaggatgcaaactaggggtggggtgaggctgtgcatgattccgtctatgcaaatcagtcaaggatttacactggaactacaaaactcgatttcagtggaaaaagcatgagtggactctgtaggcaccaggtaggcagaactccactgtgagaggggctcaggtatcgagatgcagctctgggcaagacccctgtgaggcatagccagatttgggtctccaactcaacccctgattccagaacctcagctgcctcttacagagaagatgattctgccacttttgtttgtatgactttgtaactctaagaaggcatttttaaaaagtaagtaggcaataaagaaatggtacttctatgtaagtagtgcatgtgtagtagtgagttttgtgatcaatatacattgctttgtatgtgatttgcttttaagatgttggaaatgagaatctgatatattagagaatttgacttacaagatttgcaattttaagtgtaacacctaggaggatttaatgaattaattttgtagtcaatgtttggatgctcaggagaacctgaatttatcagtttaattctcagcaggttgaaatgctttaagagaatttgtgtgctaaatttagaagttttgatttattagtcttacaagaactaagtaagtcctgagaaagattttgtttcttctatttgtaagtcttcctgttagggatttgaagattttaacaaagccagatgtatcaaatttgtgagtatagtttgaaatgcttagaggaatttaattaatcaagtttataaatactgtttacattttgaaagattatttgatttgttaagcttataaaaattgtgactaataaaaatatgtaagattgatttgattaagtttgaaaatggtattcaaatacttagttggaagtattctatctcatgtttaaagatttattgagctttagtcaaagaacaaaggcaaatgaatgtttcatactttaatgcacacaaactagatatataagaaaacttccatgatttataaaatatgttcaaaggctaaaaaacactgtaacttcaacaaattgaatatcaattaaaactcacgcagctataagagctttttgcaatgaacacattctcattcagatattaaacaatgatgctcactccatataagggtggtgactttgtgacataaaggattggaaatgaatgcttaggggatggtgtaaaagaaaacatttgggttttctggaccatgatatacaatatccaaatgatggactactggtagactgtgtgtacatttccaaagatggaaagaatgttgaaaagcatttagcaagagatttgctgacccagtcaggacagttttaaactaccatctttagggggaagaacataaatgttttaccctgtagctattgtacttgatgtagaaggaatccaggaggaggctgagacaagaatggacacgtataatggatatgattgtgtgtcagagtttactagagggcataatattaattactattaattggtattttagtggtatttagtggatgtcagacttttcaaatctttccctctcttcttaccttctacaaggtaagtttcattataaccattttatcagttgaggaaactgggggcccagataggttaaataccttgcatatgtacacatagctactaagtggtagaaccagcactggaacccatcgcctgggctctttcctaaccattctactgccaaaggctaggagtaagtttattaaagggtgcgctcatacaaaagacatgaaaggcactcaacagggaatcccaaatattaaacatagtgataaagctgaattggaaagtagattaagaactatacaagagaagggcaggggattaggcccagggctgcttagacaaattaatttccttgagcagttcatatgtagcattaaaactcatgctgattcgtatgtctccaggtcatcataaagcacctcttcatctttggtgctcctcatccagagagcttcatatttccccttccactgaggtggaattgaagtctctcaaggtggcaagagagaagtttggtgcaatgtaagccagttccccagtcagtctcacatacgtgggacttcacatgcaccacttcatgctggaattttcctgtgtctatcgtatttttatatggtgtgaacaatgcaggagttggagggctgggtggagagtaggtttctcctggtttcacctcagcaaggacaagtaaaggagagagtgcacctgctgctagtggggggtgttagagaaaaatccagggggttgacagcagttaggccagagaagggtccataagatggaggaggtgcttatcattttcatctctctgagtttctggtatgcttgggtagacgggaggtaagatggtaatgataagcacctcctccaatcggaagtcttttcctggggcacaatacctgttgagggtggcaaggtgtgggtcaggtatcctgtggggctcagtcaactggagtgtggaagaagtaagtgtgagttagaaaccatggttattctagaacgggggttctgaatcaaaagcattctattttgtaacaaacctttatggtagggagaaatttggcccagtttttcttttgcatcaaggcacagcatcgtaagtgtgctatacggtctgcttgaggcatcgggtctggtttttagattttggctgatgtgtgcagaagagaagcatggtcagtttgctcatgacgcacacattttaatgagtacctactctgtgccaggcacttggataggttctgggaacaggaaacaaaataagggatccctgttttcatggagcttgcaatctagtaagcagggaggtgtgggagagatagacaaggtacagacagttgcaacaccacgggataaatgctgtggaaatataaggacccctcagctagacttgcaggtctaggacagcatcttagtataagcactgagctaagtcaaagaggacagcaaggtcactagggaggatgccagtcctaggtgtctaggtgatgctagacagagtgatggtagtaaggtaactctgttctggtcatctccttttaagagggccattaacaaatggaaataaccagtagagactaatgatgatgatgtaaagttggaggaaccagggacagttaaccagagctggggatgcttcaagataaatagaagcttaataccttatccttatacttactggaaagcctgctacgtggaagaggcctgagacaagtaggaatagtccaaaaccaaagaggcaaatttcatttcaagaaaaggaagaattctgtgatgatttaataatttattgaatttaacaaatgggaaaaatagagtagaatatttaagcagagtttggtactcttacaatggccctgtttggaaagttgaggggttgaacttttatttgggtggaaaattgtcaaaaaggcctctagtattttctcttgtgtgataggactcttacattgcttttctgcctccaatgacagttttccttaaatgaggtatcatccaaaagccaccaagtgcaggagcatgtaggcagatgtctaaggcacataaaagcaaattgcatgggtcttcaagctgtgagggggtggagagtgggaggacaatgctaaaagaaattgtttctaatcgctcttccaggttgaaacagaatcctcattggcatgatgaagattaaatgagacaatggactggagggaacataaataaaagatatcattatcaattttattaacataaaacttcctttctagtttccaaatgatggatattaataaattattatgagtattcccaatccagtgttcttgaagttaattaaaacacaaaactccacattcatttccctgtgccttgctgcctctcttcctctttgtcgtttcctcctcttctttctcttcattctctttcattctgtctcctccttctcttttctctcccctccatcctctctcccctactgccctccctctccttcttcttctccttttaccaggaagtctttcccatattcccaagggagttctttgctctaactctgctccctctgcatggcattgattgcattgggttatatgctgttcgtgaccttgttaatctccaaagactgagacacaatggcaaaggcaatgtcttactgcctcagaatatggcacacagtaagtgctcaatagtggtttgatggacggatggatgaggaaagagatcattcccttcactgccatctaattttatttcctcttaccattctctgctgatattgtctctttgatccctggcttgtcattctctagcctcacttctcaagtttcttgtcgggcattccaactaatcgttatattttcatgtcaaattcaacatagagtattctcatatttttctgggcaactcctcaattcattccctgattcacctgtgaattcacttcggttgaatcagtctgtcattgacctgaggcactttgcaacatttgacttccatgcttctgtcatacagcttcttctacctgaaaggtcatttcttttttttttaatcaacttctctaaaaatcttatctaatcttcaaggcctaactcagttgccctatcttgaggtcttccttgatcattcatcactgctgggcaggatgtccctcctcttgtctcctatggaatatatctgtacaacccatatgaaacattttacttaataccttatattttagttacctctaaatcagtcttatttgccttcatatatagccctttgagggaataaacaaggctgtgagttaggaaacctcaccttaccttgatggcatcaacacttgatagactgaatatctttatctaagtttgatggtgtttctgtctcatgatcctcactctaattcagcaacaataatagtaacagtgtcttgtgcttgtgctatgtgcttttattttgagaattattctttatttgcctccaattcaaactatgatttcttccagttttttaaaaaagtaacacccttgaccattcaggacactgcaggctcccaggagtagggagagagtgtggcaagtgtaacggagcagctccagagaggaggtgggcattggacctcttgaagaaaggccctgaaatctaaatgacccatctgagaattaacaaactccattttgatccacatcaatgctgacattggaaaagacagggccagttgtggccaatgagcttctagtgaatggccattcacagcatcacagcagtgcatggtaatgggtttccagggccatccgaattagtgcaaaggatcctggaatttaattccccctccaggtggggtgagggaagactgctctgagataaacaatgagattgcagttcaaccaacaaggtaaagttcaaggatagagtgcaggtctaatagagacctggaaagcaggatatttaaattggtagctgagtatggctgggacagagtgtgtagacacgagttcagtggacaaagtttttgtgatttattcatgtttttgttctaggttcctcttttacattatcagctctctcagagagctcaattcctcttttgccttcaaccattactctctctgggcaactatattttttggtctcagagagaccattttatttggagtctgagtgagcaactgctacctttcattttgctgaaattatgcttgcccctaccaggtagagaaacagtgataccaggccagtgcttgtctggacctcgctgttgctcctgttgctatgtgcatggtttcaaatcaggttatctgttgcccattccccagctccctgcagggcttggagattgcctcccttcctctactcccttcttaggttctgctccacagtacttgccagagcatcataatagaaccagtaattgtcaccaactcctgaaaatgggggttaggggaacggggctgttgaggggggagtcatcacctctctgtgtcccccatcttcaaatttcatgaaacatcatacataccttttagttttatagttgtaaagaatttttaaattctaagtcagagaaattatagagtttcaatagctaaaatccctggtatttgttggagtttagatagaggtaaacctgatcttatttagctacatttgtctctgaaacatttttaaattctaggtaactgctgccttcaaaaaataaaactctttctaatggagatatttcttccctcccctcctctcctatccccttcccacctcccacttttcttccctcttccctccttctcctaccttcccttcctttccccccatccctttttttccttccctgaccccaccccacctttcctgtagaaagactacaggaaacatttaaattagtactgcaatctgcaactgaagtttttctccgcatatatcttgattctaataggaaatttgacaaagtttaccaagatagtttgactcaacaattcctttaaaaatcctttaaaatgagaagatatagctttttaaaaattcattttatttgatgtagtaattctacttattgggatctatcttaagaaaataatcaagaaggcaaaacaaaattatcatatataaatattccttagattattaattataatagcaaaaatctagaaatcacctaaatacacaacagtagagaaatgactacgtaaataataatagcatattcacataatagaatagtatgaagccattaagattatgtttctgaaaacttttgaataacacaggaaggtgttattaaagtctttcattaataccaatggaaaaatataggctacaaaattatatagaatctaacctcaattatgtagtataatagtcataaaagagaaattcaaaggttagcaggtgttgcttcttgtcggttaggtaagggggattggatttttgtgctcttcatatttcccaagtcttctgcagtgaacaggtttaattttacaatcaggaaagccacattgctgttatttttaaagacttgattcaaaggttgtctgttaaaaattcaaggaatatacaaacagctgatttaatatttcctctaagtctgcatttccatgctggagaaaagggagataacttacagggagaggacttaaagccccctttctttccaatacattcttgggagagaatggatgaccacacatgcaggaaatatattcattggaaggcctgagggggtgagtttatagtgtgctcaccaggctgagcaagaaaaaatagaaggagcacttggcagacatggagacagagacctgaagtctcatccctaattctaccttgaactctaatcttaggaatgccattggtaacctccctgggctgtatctgcatgttggaaacatggtgacattccctgtcgctgtcatttcctaaagctctggcatccgagaccttttggtctcactgagcaggtatcacagagggtcggggctctgcggtggtttacctagagaaaaacaacaacggagctgaaatctggctccctgcccaatccactgtgcggactctgactctcatccccacccctaaccttctaagttccagaggaaagatcagggctgcagaacatgtttctgtgtaagccaaaagagagagctgtctgctggtgctccatcagctactgaatgctccagctcacactgactgacaggtcttcctagagcttgtgcaaagccccagtgcagaaaaagcaaacaaacaaacaaaaccccccaaaaaacttgccctctaatttagggggcatcaagagagtgtttgtaaggctgaactggcatcaggtttcactaccctgatattcacttatatatcatgctatcgacttttttaagtttaaggaagctgttatgagattaaaggagcatgtcaatgcagaaagatttacaggtgtacctcactttcagcaaactgaatatctgaaaaccagtgtagtacaaaagataaatttgcaaaataattcatttcactcccactttgagtaattggtttaccatctacatttaaaatacaaactgattttccacaatttgttttacataaaacatagtaagcacataggagctgcatatagagagatgtacagggaactaacaaatcagtatttggacaccactgcaaaggatggaaatgaagatttccctgattttaaaagtgttcattgactacaggagctaaaaaagacttctaataatttgcaagttataaacaatctttatgcaaagagggttagtagtttggaattttttttgaagttttctcctagctccttctttgggtttctcacattcagttatctcaggaaggacatcaaaagactccattttaaaatcacagtggtaggtgttttaagcatactttcacatcccaggtaaacatttaacacctgtgcacacatagacatacacattggagacctaagatactcacaaaggagacaataccaacagagctgtgctccaataatcaattttccatcatgctacctgaagagccattcattccagaataccatccccagtgtttgaaatgccaaccttttcactttcagtcagctttgggaaccctaacctgttggttgccggaacagaagagctctcaaatgcctttgccaagcatgtttctctgtggatagagacaggctaaatacatacattttacattgcaggagaaatttagaacacctcttgggtaagcttcctggatccctatccgtggagtttcttaaggatagcataactgtctctcattcctgaatgagaattcctagcattacagagtaaactgcattagaattctgagtatcttatgatactgatgaaatgctctttcacatccaaaacaaacaaacaaacaaacacaaaccaacgaaccaaccaaccaaacaacaacaacaactacaacaacaaactggagagttgcagtgggagcagaaagtcccagaatcctctaggtgtacttaaaacaggaaggcaacaagaggctgtctgacagaaaaacaggcctggaggaatttacaaagccccttccagggtctagtcctttgaccaaaccctaggtattgtttgcagcctgcaagggtaaaggggagaaggaatatatggaaaggagcaaagcagaagttgaaagtgtcaggaagatgagtggagaagagatgaagaaaggggagttaaatgaagaaaagggggatgtgtgttgaaaggaagagagagagtgatgggtaaaaaagaggaaaaaaagttgaaatacataagatgaagttccccatcaacaaatgactcagttgatcagtaaaaaaaccctcagagtggccaatcttccacttgacccataccccacccagttccaaacctcacagcaatgccgtggtcctctatgagcactttctcgccttttcacaaaggctaatctcacctatcaaaggccacagccgtcatggagtagatactggcgaagacagcggcgatgggaaagaagttgtggaacttgcagtagaacaggccgtagtaccattcgttgtggacagcataggtgaagttcaccactgtattgaatgcagccatggaggcctccgcgaaggccaggttcaccagaaaatagttcgtcactgtcctcattcttttgtgggctaagatgatccacatcactaccacgttgcccaccacagaggtcaccacaatgaccgtgtaggcagctgcccaaaggacaatttgccaggctggttgcacgaactgattgggttccgaggtgttagtggagatgtttggggagaggtctgagtccaccgggaggacgttatccatttcgaagctaggcggtaaagccctactatctgtacacaacccccctctgcagcagagtcctgtggctggcgcctggggctcagggtccttctaaagccagacaggagggtggaaggctttttctgggcagcactctttttgaaagctgaactggcgctcagaatataaacgcttctggatgcactgcccgcctgcccgcggtggctctgaattcctccactttcaagcttcaggagacgtttgagttcagaagtctggagacagcatctctcttgcggtaaactgaaaaagggaaagaaattccaccggtcacagttctaggaagcaagagatcccccgcatttatgcacctgctgctgcctgcaactcctatttctccttcctccgcagggaaaggcaaagccctgtgctgcgtgaggacttaggagcgaagtgggggcccattgcagcgcgacctgtaaaagttctgagcctatggccaggattctggagcttcgtatccagctggagatttttccttctcttttgctgccgctgccgccgcctgcagtttcgcgggcacctctcggttcgggttgctcagctcgcgagttagctgcgcacgaggcttttataaccccctgcagagacgtcactgggaaggggcagtacctgggctgcgtactcgccagtcccggtgcgcagcgcggcagctgcgccagctgttgacaactgtctcattccaccgccgcagctaccacgccttttgctgcttgctacttgccgtgggagtctgcgagccgggagccccacgcactccgcgagggggcagtaggtggcttggaagtaactgacacagatgcggtccgcagctggaatcgtcgttgcacgaggggtgctgggaggaaggaaggatttgggaaacagctggagtggaggacaatcaacttccagggaatgaagcccagagccctgagacagctctgcagaggcggcttgcctgtggcaatgggaaacggtcatgtgtgggggcgatgtgccagcgccgcgctccgggccgcgctccagctaccgagaagccagaggcgacgactccctggtccaggtgtcccgaaaacaactttcctgaggctgtgtttaggaaacacccccacaaaatatctagctcagttacctggctagctgattcacctgggaagtgacagtctctaagctttgaggacactttcctcagccaccctggtgacttggcccctcgttccaggagaagctccatttgagccctccacctgacccctctggatgagcctctgctcaatcactggggacagggctgagctccctgcgaatcttggtgagcgcaggagccacactcataggcagcttgtcgctcagacgcgcggctctgggctctccgccagcaatcactgcggcgctgcgtttgcctcccggggacctggcagcctccgcctccgcgcctgccaagcctgcaggccagagccgggctcggggtggcatcggtggtccttctccctgttccccttccaggtttgcataggggctggaggacaggtcagccagccttctctgcccgcctccatcctgccctgccgtcttctgactttgaggcctcgtatcccagtccaagaccatttcaaacggtagaactggtgccagacacttggaggaggcagggcaaagactcgccagtccgtataaacccttttggagaagccaagatgggatgagctccgcagcacgttcccgccagactgctgcaggcagagttccgcggaaaactgaaccccgggagtcctcaggggcccatctaccccggtgcaccgccccctcctttcactgcggggactcggagctgtgggactggagcgcgcaccggcagacttgcgcgcaggttggagttggcgcacacccgcgccagccggggagcggcgtttacgcactggtaccgcgagcgctcaaagcatctctcgggaagtgctttaaggctgggaaatttactatacacttatgccgggcaaaaattggatcccacgccggggaggagaatctgctgtttcactctgtattttttcggagcctgggattttagcgtatataggaaccgcacattgctttgccaggttctcctaggcacccgtaaacacactgcatagaaaactctagagatgctttcaagagaacagcgtccctttatttagagcggctgcacaagaggtcttctttgtggaagggaatgcctcctccaccttggatctctgcttgaggcttccaccatctcaaagagctgacagagagagggaggaaaagggagagggaaggggatgcggagggtgggggaggggggaggggaaacttctctatctttaattttccttccaagctgtttaaagttatcttttcttttttctccctgtccattagagccaggctgacgttttcaaaaggaactttattcagtggttaagggagaaaaagaaagctaatcgaataaaatctaaatatgtaataagagctaaatataaaataaatatgaaatagctaaaaagtaaacattaatccatttatcctccattagtacagcaagttgatattttgaagcaggtactgtgctgggcactggggctggggggtgaacaagcacttacagtatggaggaagacaaacaagaagcaatgaaccatacaaaatgggcggtattatgatgaccaaaggtactaagccctgagtgaggagagaagagggaggccacctaacctaaacaatgaggggtatccgtacagatggaagaaaatctcatccatgaagaagcctgaagaatgagttaggatgggaagaggttgagggtggaaaaaaggcgaatatttcaggctgaagttttataaatcaaaccttgtcactctgcttaaagtcccataatgactgcccacctatgagcctgcaggtcagagcggggccctgggtggcatcaggggttcttctccctgctcaccttccaggtttgcatagggactggagcgcaggtcagcccgccttctctccctgcctccatcctgcctagccctcggctaactttgaggctttgtatgccagtccaaagccacctcaaatggtggaactggtgccaggcactgggacacctacgttccttaccctggccttcaactctgatgtgttgatgagtctgacttggggttgtttttctttctactccgggattttcatggctggtagccatatcttaggaatccttatgacttgctaaagctagtttctcttcttaaaaagaaaaagcatattcatgatgggttcaccattgaggaaaaaaaaaagcctcagctatacagtagcagaagttgtttttggttcatacctatgatatgaggagacactttatctagcatcacccatctataaagtaatgaattttccccctacagctttgcacaaatatatagataaaattctatacatgctatttccctccaagagctgatattcttgttttcttatcctttttcccccttcgttcctcttttcactgaacatcttccttgacactcaacacaggatcacacatcttaaagtaaacgctgttaacaatgtagtataaatccttccttatttgtccagactctttgatactatctagatggaaatacaaacatacataatattcacacatgtaaatgcaaatataggactttcattgttgtctgtattttgtttttcccactctaaactttgcccagctgtttcagagtcaacaggtatagatttaactcatttttcagtggttaaatattatttctatgttatggatacaccgtaatttatacattcaattctctattcatgaaaattaactttgtttccagtttttgtcactaaaggcaattaacaataaacattctctacatcctggtgttttctttctatgggggtagattcaaagtggaattgctgggaagtagattatatttatattcctatgcatatgcatatatatgttgtgagtttctattcatatttgtttatttttaaaagttttaaataaagttttgtttctttgaattatttcctatattttatacaaataactaagagtctataccaacttcatgtattactttttaaagcgaaaacatgaattatttgcaatttgcccatatatttgcacatacacagacaccagcatggtttttaaaaaacttttattttgggttcaggagtaacgtgcaggtttgttatatagataaattttgtgtcacaggggtttggtggacagattattttgtcacccaggtaataaacttagtatctgataggtagttttttgatcctcaccctcctcccaccctccagccacaagtagggcccagtgtctgttgtcctttctatgtgtccatacgtactcagcgtttagctctcacttataagtgagaatatgcagtattttgttttctgttcctgcttcagtttgcttagaataatggcctccagatccatccatattgctgcaaaggacatgatcttgttcttttttatggctgtgtagtattccatttacacgtgtatatatataccacatttatatatgtggtatatatacaaatatgtaccacattttctttatgcagtgtactaccattcatgggcatttaggttgagtccatgtcttttctattgtgaatagttgctgcaataaacatatcagtgcatgtatctttatggtagaacaatttgtatccctttgggtatataccctataatgagattgctgggtcaaatggtaattctgttttaagttctttgagaaattgccacactgctttctacaatggctgaactaatttacattcccaccagcagtatacaagtgttcccttttctttgaaaccttaccagcatctgttactttttgactttttaataatagcaattctgactgatatgggatggtatctcattgaagttttgatatgcatttctctaataattaatgatagtgagcaatttttcatatgcttcttggccatgggtatgtcttcttttgaaaagtgttcatgtccttcgcttactttttaatgaggctgtttattttttgcttgttaatttaagttcttcacagattctggatattagacctttgttagatgcagagtttgcaagtatttttttcccattctatatgttgtccatttgctttgttgataatttcttttgctgtgcagaagctctttagtttaattaggtcctatttgtcaatttttgtttgtgttgcaattgcttttggcatctttatcatgaaatctttgccagggcctatgtgcagaatgatatatcctaggttatcttccagggtttttatagttttacatttaagtctttaatacatcttgagttaatttttggatatggtgtaaggaagtggttcagtttcagtattctgcatatggctagccagttatcccagcgccatttattgaataggtgctgttctaatggtccatgtgtctgtttttgtaccagtagtatgctgttttggttactgtaaccttgtagtatagtttgaagttggatatgtgatgtctctagctttgttcattttgtttagaattgccttggctattcaggctcttttttgattgcataggaattttaaaattgtttttctaattttgtgaagaatgtcattggttgttaggaataacattgaatctgtaaattgctttgggtagtttggccattttagcaatactgattcttcgtatctaagagcatggaatgctgtttcattagtttgtgtcatctctgatttttttgagtagtgttttgttgtagagatttttgttgtagagatctttcgcttcccttgttagttgtattcctaggtattttattcattttttggctattcttgatgagattgaattcttggtttggctctcagcttcgatgtggttggtatgtagaaatgctactgattttgtacattggttttgtatcccgatactttgctgaatttatcagatctaggtgcttttgggcagagactatggggttttataggtatcatctgcaaacagagatagtttcatttcctcttttcctatgtgaatgtcttctatttatttctcctgcctggtagctctggctaggacattcagtgctatgttgaataggagtggtaacattgggcatctttgccttgttccggttctctagtggaatgtttccagtttttccccattcagaatgatattggctgtgggtttgtcatagatgcctcttattgttttgaggtatgttccttcaatacctagtttactgaggggttttaacatgaagggatgttgaattttatcaaaagccttttcttcatctattgagacgatcatgtggtttttgtttttagttttctttatgtgatgaatcacatttattgattgcatagttgaaccaactttacatcccaggggtaaagcctacttgattatggtggattagttttgctgctggattgggtttgctggtattttgttgaggatttttgcatcaatgttcatcaaggatattagtctgaagttttcttctttgttgtgtctctgccaggttttagtatgtgaatgatgctggcctcaaggaatgaattaggaagtccttcctcctcaatttttgagaatagtttcaggaggaatggtaccagttcttctttatacatctggcagaatttggctgtgaatccatctggtcctaggctttttcagattgataggctttttattgctgattcagtttcagaactcattggtctgtttagtgattcaatttcttcctggttcaatcttggaaggctgcatgtttccaggaatttattcattttgtctaggttttctagtttgtatgcatagaggtgttcatagtagtctctaaaggttttttaaaatttttatttctgtagggttagaaataaccctacatctcctttgtcatttctgattgtgtggggtgtttttttttggatcttctctctttttttctttgttagtctagatactattctacccatgttactcattctttcaaagaaccaactgctggactcaatcttttgtatgacttttcacatctcaatttccttcagttcagctctggttttggctatatcttgtcttccgctagtctggaggttggtttgctagtttctctaggtgtggtgttaggttggtaatttgagatctttctaactttttcatgtgagtgtttagtagtataaacttcccttttaacactgctttagctgtgcccggagattctggtatgttgtatctttattctttctggttttaaagaatttcttgattgctgccttaatttcattgtcattataccaaatgacaattgtacattgtcatttttgttgtacccaaagtcattcagaaggaggttgtttaatttccatgtaactgtatggttttgagcaatttttaaagtattgatttctatttttattgagctgtggtccaagaatgtggttggtataatttagtttttgttttttaatttgctgagggttgttttattgctgattgtgtgatcagttttagagtatgtgccatgtacagttaagaagaatgtaaattctgctgttttgggatggagagttctgttagttcctattgatcaagtgttgagttcaggtcctgaatatcttcgttagttttcatccttgatgatctgtctaatactgacagtggggtgttgaagtctcccactattattgtgtgattatctaaatctttcataggtttctaagaacttgatttatgaatctgggtgttcatatatatatatatatgtatatatgaacaagaagatctaactatcctatatatttatgttttaagagattatttatatatatataggacatataaggtgagatatatatctatatctatctatatgtaggatagttaggtcttcttgttccattgaactccctttgccattatgtaatgcccttctttgtctttttgattgttgttgctttaaagtattttgtctgaatttaggatagcaatccttgctttttttctgttttcctttgcttggtagatttttctccatcccttcactttgagcctgtgggtgtcattgcatgtgagatgggcctctagtagatgttggttttccattcctgagttacttcacttacaataatggtctccaatctcatccgggttactgtgaatgcagtattccatctcatatatatatgagtagcattccatctcatatatatataccacagtttctttattcactcattgattgatgggcatttgttctggtttcatattttttcatttgcaaaagtttttcgtatattaacttcttttcctctgggtagatacccagtaatgggattgctggatcaaatggtaaatctacttttagttctttaaggaatgtccacactgttttccacagtggtttacattcccaccagcagtgtaaaagtgttccctttctgccccatccatgccaacatctcttattattatttttggagacagagtcttgctctgttgcccaggctggagtgcagtggcatgatctcagctcactgcaacctccgcctcctgagttcaagcgattctcctgcctcagcctcccaagtagctgggactacagacacgtgccaccacacctgggtagtttatgtatttttagaagagatagagtttcaccatgtggccaggctggtctcgaactcctgacctctggtgatccgcctgccttgggctcccaaagggttgggattacaggtgtgagccactgcgcctggcccaacatctatttttttttattatggacattcttgcgggagtaaggtgatattacattgtggttttgatttgcatttccctgataattagtgatgttgagcattttttcatgttcgttggccatttgtatatcttctattgagaattgtctattcatgttcttaacgcacttgttgatgagattattattatttttttcttgctgatttgtttgagttacatgtagattctagatactagtcctttgtttgatgcatagtttgcgaagattttctcccactctatgggttgtctttttactctgctgattatttctttctctgtgcagaagctttttagtttaattaagtccccctatttatctttgtttttgttgcatttgcttttgtgttcttggtcatgaagtctttgcctaagcccatgtctagaacagttttttccaatgatatcttctagaatttttatggttttaagtcttagatttaagtctttagtcaatcttgagttgatttttgtataatgtgagagattaggatgcagtttcattcttctacatatggcttgccagtgatcccagcatcatttgttgaatagggtatcctttccccactttatgtttttgtttgttttgtcaaatatcagttggctctaagtatttgggtttacttctgggttctttattctgttccattggtcgatgggcctattttttttacaagtacaatgctgttttgatgactatggacttaatagcatagtttgaagtctggtaatgtgatgtctccagattcgttctttttgcttagtcttgctttagcaatgcaggctcttttttggtttcgtattaatttgaggattgttttttctagttctgtgaagaatgatggtgatattttgatgagaattgcattgaatctgaagattgcttttggcagtatggtcattttcacaattgattctacccacccacgagcatgggatgtgtttctattcaacatagtattggaagttctggccagggcagtcagacaagtgacaggtctcacacaattcccacacagcctgcaaggccattctcactcccatcatgcccctgcaacagcactgagtttatttctaggcagtcagaagcagggctgagatgttgccccaggccgcaaggtttccctctgaaaaagcaaacagggctttcaggttttgcacctccccacctgctgcggcttctgtgcttgtatctgcattccgcgtttacccccttccccagattccgtccaggaaacttcatgttcagtcaaaattattacaaagttcacctggaagttttcttctctctgtggtgtttcctcaattacactggcagc

SEQ ID NO: 477 - DNA, 110973 bp, Homo sapiens
aatcagcctaatactctaagtcatttattggttttcagaaataattggtgtgaacagtgaacaatctgaaaaagaaatcaaaaaaccaatcccatttacaatattcaaacaaaattaaatacctaggagttaaccaaagaagtaaaagatctctataatgtaaactataaaacactgatgaaaggaattgacgaggacaccaaaaaatggaggcatactctatgttcatggattggaagaatcaatattgttaaaatgtccatactacccaaagcaatctacagattcaatgcaatctctatcaaaataccaatgacattcttcacagaaatagaaataactgtcctaaaatttatatggaaccacaaaagacccagaatgccaaagctatcctaagcaaaaaggacaaagctggaggaatcacattaactgacttcaaattatactacagagctattgtaatcaaaatagcatgctattagcataaaaacactcacatagcccaacagaacagaatagagaacccagaaacaaatccacacacctacagcaaactaatttttgacaaaggggcctagaacatacactgaggaaaagacagtctcttcaataaagaacaaaactagacccctatctctcaccacatacaaaaatcaaattgaaatggattaaagacttaaatctgagacctcaaactatgaaactactaaaagaaaacattggggaaactctccaggacattggtcttggcaaaaatttcttgattaataccccacaagcacaggcaaccaaagcaaagatggacaaattggatcacatcaaattaaaaagcttctgcacagcaaaggaaacaatcaacaaagtgaagagacaacccacagaatgggagaaaatatttgcaaactatccatctgacaagtgattattagccagaatacataaggagctcaaacaactctataggaaaaaaattctaataatccaataaagaaattggcaaaatattttaatagacatttctcaaaagaaaacatacaaatggcaaacaggtatatgaaaaactgtgcaacatcatcaatcatcagagaaatgaaaatcaaaaccacgatctcggctgggcgcggtggctcacgcttgtaatctcagcactttggtaggccaaggcaggcagatcgtgaggtcaagagatggagaccatcctggccaacatggtgaaaccctgtctctaccaaagaaatacaaatttagctgggtgtggtggcacgtgcctgtagtcccagctactcaggaggctgaggcaggagaattgcttgaacctgggaggcggaggttgcagtgagctgaatttgcgccactgcactccagcctgggcaacagagcaagactctgtttcaaaacaaacaaacaaacaaacaacaacaacagcaacaacaaaaacctacaatctcatcccagttaaaatggtttatatccaaaagacaggcaataacaaacactggtgaggatgtagagaaaagagaaccctcaaacactgtcgatggggatgcaaattagtacaagcattagggagaacagtttggaggttcctcaaaaaactaaaaatagagttaccatatgatccagcaatcccactgctgggtatatactcaaaagaaaggaaatcaatatattgaagagatacctgcactcccatgtttattgcagcactgtttacaatagccaagatttagaagccacctaagtgtccatcaccagatgaatggataaagaaaatgtggtacatattcacgatggagtactattcagccatgcaaaagaatgaaatcctgtcatttgtaataacatgaatggaactggaagtcattatgttaagtgaagtaagccaggcacaggaagacaaacatcacatgttctcacttatttgtgggatctaaaaatcaaaacaagtcactttatggagacagagagtagaagattggttatcagagtctgggcagggtagttggtcaggggcagggaatggtgaagagggaggtggggatggttaatgaatacaaaagtaatagaaagaatgaataagacctagtatttgctagcacaacagggtgactgtagtcaataataatttacttgtgcattttaaaataactaagagagtgtaattggaagaaaggattgtaagaaaggataaatgcttgggaggacggatacctcattttccatgatggattatgcattgtgtgcctgtaacaaaatatctcatgtgccccataactacgtatacttactatgtacccacaaaaattaaaaatcgaaaaagtttttaaaagtttaaaaaagaaaaacaagttgttggtatgatcttttgtttgatacattctcactaatgagatgatgacttaatcagagttatgatttgacagacggaaatgctccaaaatcctccagtaacttcccttcaaatcagtggtttctaggtaactaagagtctcaaaatagagaatttctctaaataacaatatttttatgataatgaattgttcctgagcttctggtggactaagaacaattgtattaaaattttttttggatccttatccaatttcatctgagcttgttattcaacatctttttattggctaagtcacaaaagtctttggtgaaatgtcacatttagttaggttgagcctaatccttcctgagagggtcatagtatggtggctcaaactgggtgtgtgtccccaccaggctgctttcttttgttcactggctcagctgcttacataaattttaaatgacttctctttgtttcagttttctcatctgtaaaatggggtgatgatgatgatgatgataacttcaaatgagcaaaatacatttagattggtgcttggctcacaaaatgctaaacatgcattagctctcactttattaataaaatcaacgtcagtacccttgactcaaaggtgtgtggtgggttttaacgaccatgtccccttaaacggagatgaggttaaacaagaacagtgaaaagagggagtcccatgcaccctggtgtcctcaggccccaaatcatccccttggtcccttccttcccccatagcctccctcctgtcatggagcatccactattccaatgaagccctcaattcctggctggggcctgggtagggcccctactgaggaagttctctccctggctctctctaagcccgaatcccatgaaggctgtaatctccacacccagatatgaggtaagtggacagtccaaggcagtcatagccggctggctggccaccagttggctcaccaggagtctgtcctctcttcccatcattccccagtgggagccaatgatggtggccaggaggtgagactttcaggggacagccggtgtaaatattttaacaaatggaacaggcactatgggtgcattggctaaacatcagccctgtaggcccaggagacctttggccattgggtcctcatctagctggcattttcatctccctaagactcattccctcatattcttgcaagtctctcacccattcccatttcttttttctttttctttttttttgagacagagtctcgctctgtcacccaggctggaatgcagtggtgcaatctcggctcactgcaacctccccctcctgagttccagcaattctctggcctcagcttcccgagtagctgggattacaggcacgtgtcaccatgcccagctaatttttgtatttttagtagagatggggtttcacaatgttggccaggctggtcatgaactcctgacctcaagtgatccacccgcctcagcctcccaaagtgtaggattacaggcatgagccaccgcgcccagctctccattcccatttctgctcaactggcccttcttcagagaggtctctctgatgaccctacaaaaattctcttcactatcttccacccaagtcatcctatacatatgtatataccttgctgtgtggtgttttttcttacaatgtttttagtcctctctaaaattgttttttatttgtatctgttttctatcatcctgtcatgataactatggccaaaagacaagatgacaaatactgtcacaaataccaccggaagatgtagaaaacagtgtggaaaatttagaagagacacatcttagaaaaaattacactggtctgccattcaaagctttgcaatgctgctggataagatgcagatgtttcaaacatgtctctgcatgagagctgctagattctatttccacaatggaacatagggaaaaaaaaaaaccacttgtaatgggaagatgcaccaggaaacacctattctagacaataaaccatttctttttataaacaacactttgtggtaaaattgtgtctgtgtagccgggcgcggtggctcacgcctgtaatcccagcactctgggaggccgaggcaggtggatcacgaggtcaggagatcgagaccatcctggctagcgtggtgaaatcccatctctactaaaaatagaaaaaattagccgggtgtggtggcgggtgcctgtggtcccagctactcgggaggctgaggcaggagaatggcgtgaacccaggaggtggagcttgcagtgagccgagatcgcgccactgcactccagcctgggcgacagagcgagactccatctcaaaaaaaaaaaaaaaaaaaaattgtgtctgtgtaaccatgaaagaacctagaatactagaagagctctgagagaagacattgacagcaccgcgggggcaattcacccaccgcctcatccaccagcatcaagtggcagcagaagttaaaggcagaaggtgcacactgctggagtgtgtcaggatatagtcaattttatgaagacaagactgtgcagatatagcgcaggaatcgccgtcatctggactgagcatgaatatccacaaaagtcctgtgtccccacagaaggcttttggatacctcatggcaaaacatttcaaagacctgccagacccacagatgagctagttaccttcttttttaaaaaacaggaaagtaagtattcctgggatgacaagtagttgtcagtagtattggcagatatttttgaaatggggaatacacttaatttgtcccttcagggtaaagggaatgttttaacaaagtgagcatcagaatggctgggtgtcttgactgccttatctttatatttatgattgcaaatgtcaagtaggccctcatgctgcttgcaatttttgctagattcctgattccattcttccatttccaagagttattacacctctggtctcctctcaaacttcccacagccctccccactcccactctcaactgatgacttgcttccatttcaatgaagctcagagaacagaccttccacctcatgcacctgcgctgtcccacgtgctctcccttctttcctggttctgcagcagatgaaccctctatgctagggctgacccctccatggtgctgcagatcctctcccttctcacgcactgcattagtctgttttcacactgctgataaagacatacccgagaccgggcaatttacaaaaggaggaggttcaaatggacttattcagttccatgtggctggggaagcctcacaatcatggtggaaggcaaggccttgacctcctaaaatcctgggattataggcatgagccaccaagcctgatctaatttgtacttgtctgataagtaatgacgttgcgtacattttcatatatttattgaccatttagctgttatcttttatgaaatacctgttcaaatctttttgcctatttttaactggattgtttattatttcttaatagatcggtaggaaacctttgttacatgtcttgtcgaatatgtattgtgaatttcttctctcagtttttagtttgctttaattatgtctttttttttttaattttttttaaagacagggtctctgtcacccaggctggagggaagtgtcatgatcacagctcactgcagccttgacttcccgggctgaagcaatccccccgacccagcctcctgagtagctggaactacaggcatgcccaccacacccaactaagttttaaaaaaattttgtagagataggatctctctatgttgcccaggctgatcttgaacttctgggctgaagcaatcctcccacctcggcctctgaaagtgctaggttctaggcgtgagccactgtgctcagcctaacaatgtcttctgatgaatcgaagttcttaatttaatgaaatccagtgtaatgaccttttctcttaggagtagtgctttttgtgccctgttgatgaagtctattccacaccaaatcataaagatatttaccactttttttttctagaagctttatggttttacctatcacatgtaggatctatttgaattaatttttgtgtacagtgtgagaaaggggtcaataattttctcatatgcatgtctgattgattcagaaccatttattgaaaaactattctttcagctcacgcctataatcccagcactttgggaggccgaggtgggtggatcactagaggctatgagttcgagaccagcctggccaacatggcaaaattccatctctactaaaaaatacaaaattagccaggtgtcatggcacatgcctgtagtcccagctacctctacttgggaagctaaggcccgagaattgcttgaacctgagtggcagaggttgcagtgagccgcgattgtgccattgcactccagcctgggcaacagagcaagactctatctcaaaaaagaaacaaagaaaaaggagaaaagctattctttcctcactgaattttagtagcagctttgttgtaaatcagattattttatatgtacttatgagtccgtttctggactttctattcagttctgtcaattttttggtctatccttgcatcacactagattactgtatgatttatttttttctcttttatttattttttaaatctttattcttttttctctactttttcttttaacattttttaattttgagaaaaggtcttgctttgtcatgtaggctggaatgcagtggcgtgaccacagctcactgcagcctcaaccgatcctcccacctcagtctcctaggtacctgggactattggactgtgccaccacacccagctaattttttaattttttgcagaaatgaggtctcattatgtttcccaggctgatctcaaactcctgggcttaagtgttctgtccaccttggccttccaaaatgctgagattacaggctcgatgttaaacaaacttgcattcctagaataaacctaacttggctgtgatttattatcctatttatatattgctgagtacaacaggatgtacattcaatttactgatgttttgtttggaacttttgcatgtatgtttatgagaggaattgctttttaattttgacttttcttgaaatatccttgtcaagttttggtgtcaaggtcatgcttgtctcctaaaatgtactggtaaatgctcttcttttttcattatttggaagcatctgtataagatgggtgttatttatttctttttaaaattattattattattgagacagagtctctctctatcaaccaggctggagtgcaatggcatgatcttggcccactgcaacctctgcctcccaggttcaagcaattcttgtgcctcagcctcccaggtagctaggattacaggcgtgcaacaccatgcccagctaatttttgtatttttagtagagacgaggttttgtcatgttggtcaggctggtctcgaactcctggcctcaaatattctcctgcctcagcctcctaaagtggtgggattacaggcgtgagccaccatgactggcctatttctttcttaaaaatttggtagaatttggccaggcgtggtggctcatgcctgtaaccccagtactttgggaggccgaggtgggcaggtcaggagttcaagatcagcctggccaatatggtgaaactccatctctactaaaaatacaaaacttagccaggtgtggtggtaggcgcctgtagtcccagctatttaggaggctgaggcaggagaattgcttgaacctgggaagcggaggttgcagtgggctgagatggtgccactgcactccagactgggtgaaagagcaagactgtcttaaaaaaaaaaattggtggaattttcacatttattggcctagagttgttcagaatatgcccttatgatctttttaatgtctgtggtatttgcagtgatgcccctacatattggttagtgatgccactgatatcagtttattttgattttctttgctccgttgctcagactggagcacagtggcccgattatagctcactgcagccttgagctcaagcaaacctcccgtctcatcctcccaagtagctaggactgtaggtgtgcatcaccaagctgggctcttttctttttgatcaatctttccagagtttatcgaatgtattagtattttcaaagagctaatgttagttggttgagactctcttcttaaaaaatatcttttaggctgggcgtggtggctcacgcctgtaatcctagcactttgggaggccgaggtgggcagatcacttgaggtcaggagttcgagatcagcccagccaacctggtgaaaccccgtctctactaaaaatacaaaaattcgccaggcgtcgtggcgcgtgcctataatcccagctacttgggaggctgaggcaggagaattgcttgaacctgggaggtggaggctgcactgagctgagattgaaccattgtactccagcctatagagatgaggactcaatatgttgggcaggctggtctccaactcccgccctccagcaatctgcccgccttcgcctcccacagtgatgggattacaggcaccagccaccacagcaagcctttgtggagcctatcgaagcttgctttctcttttattaatttctcttttttaaacatttccttcatcccattatttttcagtttaatcttttttctaacttcttgggatgtacgattatatcaaaaatcctcttctcaatgagatctctcttgaacatcacatttcagactgaaatcaccttgttgttcccattctcctctcctctttatttttctccttggaactcaccaccacttaacataccacatattttccttatttatttttgtctctccccatcagaatacaatctccatgaaggcaaggacttttgtttactttgttcactgctgaatccccaggacacaaaccagttcctgtttaataaataaaacaaggaatgaatgtgttagatgaagaaacaataagagctaaatttattgagcacttactgagactcaattatattcactcatgcatttatttattcagttatttacttatgcagagaaggggtctcgctttgttgccccggctggtctccaactcctggcctcaagcaatcctcccgactcagcctccccaggattacaggcgtgaaccagcacgcccggtggagactcaattataaggggctcacagataacatctaattcttacagaggagtaaactgaggcacaagtaagcaggagagccgtgattagaaacctaggtctaactcacagcccgtgagctttcctccaagccccgaggcttccccttaaaaaagccagcaaggggcgagactcggagggcagaacccacggagggcggaacccacagaggacagagcccgcgctcgcgagcacggccttgtccgaccccccgtgccgccggaggagcaagtctgtcttggaatgaatgatcgtcggaacggagcttgatcaaaccactcagcagtaggcgtcgcccactttcttattggttggttttggttctcaagagtaggaaagttaggtagtccgcgaggggtctgcgagctttgcggagcctcgcccccgagcgcgcggtttccctgccgcgcaggcgcacggaatcctaggcgcggatctcgcgtttccggccggaagcttctccagcctttcccggaagctgcgctcgctacccgggtaacgggtcccggctgtggaagctcccgcggcgccgcgatggacctcgaggaggcggtaaggaggcggtgcacctggcgggccacgatcgccggggccggaggagagagaagctgaggaggagcggcggaggacgccgcgggttggggcggcgacgccaccggctggaggaaggcggggcggagggctgcagggcgggctaaggactggggctggccggccgcatgcgcgcgcggctttggtaaagaggctggagtttctggctcggcgaggttgtgggggagggagggtgtggtgtttgtcgttatgggtgtgtttaaggatgaagctgtgggttttgtggggtggccacccacagggctcatcctcgagactggaccacccacaagttccctttaatgctggggtgggtgagggaggggcaggggttggaacctgagatgccgccgggtaacccctgtcggtctctccgggaatccttgccactgtctccagcagggattctaaattcgggtttgggaactccccaaattgtccagctatcattcatcgtagtgttagtacggggtcactgaacactttaccaagttgccaaaattgatttggcatgcattttgttttgttttaggtactacgtaaaatggcacatttttgttttttatttttgagacaagatctcacttcttcccccaggctggagtacagtggcacgatcacggctcactgcagcctcgaatcctgggctcgagagatccttccgcctcagccttccaatgagctagggctacagacatgcaccaccaagcccggctaatttttttttttttaattttttgtaggggcaggggtctcgctatgttgtccagactggtattgaactcctgggctcaggcgatcttcctgcctcagcctcgcaaagtgctgggattataggggtgatcccccgccctcggccaaatggcacacgctttgatggtattaaatgatactcgataattagatcaatgctaacaacaagtcaaactccaaagagttggggatcagagaattaggcctgtatatacaggagcagtacggtcttatagtagaggcttaaaaaatgtttactgatgatggttggctaacttctgtaaatgctaggctgatgaaatgaataattgtaactcaccattagctagcgtatacccagactagggatcatgtctggtctgttttgctcaccattgaatccccagcacctagtaaaaagcctggtacacacatagttgataccccttatgctgccgagtgaataaatcgaaacttgaaaccattacaaatctagttcctctgtggtatgcgcttttagtgtcctggaggagttccaaattgtatttgcattttttaaaagtcttctctatacttgtttgtcatcttctcacagtattttcaaggagctttgtttactcatctttggttccagtttacccctactacctccttttctttttttttcctgtcacactgcatatttcaataaattttctccagtagtttaattcggtttcataccgcgcctctccttgtttgcggataatctctctgacatattttttattgtctatgattttttattaataaagttgccaggaacccattaaatagaactgcaaggtttaggtacgatgtattgaatgtggcttgatgggaacaccttttctgtcctcttctcccataggaagagtttaaagaacgctgtactcagtgtgctgctgtctcatggggtcttactgatgaaggcaaatattattgcacttcttgccacaatgttacagaggtaagtaacaaatatcatttatgaatttgcttatgttttaaaaattgccatttcagcctgatatgtagtctaagtcccaaagaattgggttgatttttgtcactcatgcaatgccaacattccaaggatgcatgtggtcttaggtacttacacataggttaagggatttgtgaattagattgaggatgagtttttgaaattatgttgggccacatttataaatgatttcttattcagagtatgtggttgagggaaataattaaaattgtacttagaagatgatgcatttctttttatcagttagtacttatttacatttttttaaatgtgtcatggtggcttagaggtttggaagatggaatgttagaaaacttgaggactgggccgggcgcagtggcttacgcctgtaatcccagcactttgggaggctaaggcaggtggatcacctgaggtcgggagtttgagaccagtctgtccaacaatgggaaactccgtctctactaaaaatacaacaattagccaggcgtggtagcatgcgcctgtagtcccagctacttgagaggctgaggcaggagaatcgcttggacccaggaggcggaggttgcagtgagacgagatcacgccactgtactccagcctgggcagcagagcaagactctgtctaaaaaagagaaagaaagcttgaggactgttgggaatattggaattattcttcgttatccttttacctttgtatagtaccttacagattacaaagtttttggatccattatctcatttcctcctcatcactaactgtgagagcctattgatagggctcagaagttgagtgagtttgccaaagttacccaagtaccaggacttgaatgtgagtcttctgacttcagtgttcattttacccatcacacctgcctcttaaagtagagattgtcatattgtcctgtgtaaccttggtaaacgaggctaccttcacattgtgagtgctaggtcctattgtggtgaacacaccttcgggccagcatcaccaaagtgatcaagggtgtagagagtctgctgctggacaggctaaatgtgccaggactctcctcagtggaaaaggatttcctcaaagtctacagatccaggaaggaacaaatgttaccttcaccatacaggcttaagaaaggcaaatttgggacattaaaagtaactgtgtagacttctgcttctggctaagatggactaacagagaccagacttacctttgtcccctaaacaatgaaaaacctggacaaaatatattaaatgagtaaaaggaaaaacattttcccttgacaaaactggtgaattgagcttgcaggtgtgtcacacaagtgcttttccttgaggcagtgttcttgagtctgcagctggaatgcttatctctgcttcctgtttagtcatacagaatattaaaaagatatgtgctcacttgatgaaattgttggggtgatggagatatttattatcttgattatagtggtggtttcatggagatatattttgtgtgtgtgtctgtgtgtgtcagattgtgcacctgacagatgtgcagtttggtcctcaccctcattgtgtagtaaggagctagcagttttactcactgttgcttttgtactatagtgcaggtgtaaacccagtgaagaaagattatgtctaatggagtatttgccattagtagatgaagtcagcatactatttttataggaattgaactacattaactaattgcttttctatttttgattttgatactgtttccgtttgattctgtttgatcaaatctgctgcagtcattttttagtttgaaagatcctaatacttctccctagctccacatttggaagactgtcaactcctgtggagtaatttgtcaagaatgtagagttcatgaaggtggacaacatctttataaagaccaagaacctagctcagtgccttcctttcagacgacaggcttaaaggaaaaaaaagttacgtgttgcacaacttcagtagttattcttggctttatggcggtccaggcatgttcttcacatggactgtgagaatataatgtggtaggggctccctggagctgagcagtgtggcgatggtgatgttgaaatacagtgggtggggaatggcaggtgagacagttacagctgtgaagaatggaagtcatggtgcaacttgccctatttttctgccccttttattgccccctcttccttggcatgtaactgtcaagctccagacacgctctgcaatctgggaaaggccttccagattgataaaggaaccaaaatgttatcctagtatattttatccaggaaaaaaaaatgtaaggtcataaatctgttcaatttagacaatagatatttttgcaagagtttcacggatatttaaaaaggtgtaggctagacttgtgtgaatgtaagagatttttatgatcataagagcaatgcatgtttactatagaaaatttggaaattgtgaagatgaaagctaaaatcaccagtaatctctacatttgtctcttttttcctgtgtgtgaaatggagaaagggatgtgtgagtgctgttcaatcttctgccgtaacaacttggaaaaatacttttatctaaacatttgcagacattttttatagactgtaaatattccataatggccatttggtaatttaattaattatagctctagttttggatgtttcattttttcaggttttttgctctttcacgttttgtctagtacagattttaagtctttttttcctggctaccctttgcaagttttactgtctttgctagataatggcttttgtatttattttgacgtgtcttatgttttcagtgtggccaacccagtataccaaaattgctttgaatatggtttctgtgattagagagactacgttccaaaaatcctgttggtagagacatttcttttattcttatggagggttaaagataaatttcattccaaatctctaaatttagaaaaacagtaatgtcctctgttggttaaaaatcctcacctttcttctggcattaagactcaataatgggggctgggcacggtggctcatgcctgtaatcccagcactttgggagaccgaggtgggcagatcacctgaggttgggagtttgagaccagcctgaccaacgtggagaaacctcgtctctactaaaaatacaaaattagccaggcgtgatggcgcatgcctttaatcccagctgctcaggaggctgaggctggagaattgcttgaacctgggaggcaaaggttgaagtgagcagagatcgcaccattgcactccagcctgggcgacgagagcgaaactccctctcaaaaaaaaaaagaaaaagactcaataatgggaacatttattctactttatggaataaagtgtggccccatttaaaaaaaaagactcaacactttatttttagttgtgggagagccagaatctttgatatttgcccttgagagcagttaagattgaagactctgatatgaattatactaaccattttagtcattctaaagttctctaagtttgattaaaaataaaatgtaatacgtacttttataatttcagaaatgaaagcagttttagagtattattcaaagacatggaaaagtaggccaaaactaatctgtctgtagtttaggcattaccagttacaaaaaatacataaaactgttttcataccaaagtgtattttgtgtggagaaaaaagtgagtagatgtaacttttagtttggcttggtttgtaaaagttaaaaagtgatttaaaataaaagttattcatttaacaaacactttatggttactgtattccaggcactgttttagttactgagaaattttgaatgaaaaaacaacatcaacattaactagaatgttaaatgtttataattttcccaagattttaccatccttggtcctggcactcacaatttggtttattatactttccagaaaatacctggaaaaatgcttagggggatgtaaaacgatcttttttaatggtctttttctctttcctgcagagatatcaggaagttacaaacactgatcttattcctaatacccaaataaaagccctcaaccgggggcttaaaaaaaaaaacaatactggtaagttctttcttcatatgtacttaacattctttattcacatctttcaccttcatgatgtcaggacatggaatggaattttaagtaggttctagagaaaatgccagattttatctactggcatacgttcttctatcctatgtctgtattcattgtgggtgaatattatttctggtgcttttatagaaaaaatgcttattttctgaaataattcaaccgtggaattgttaggttaggtgagttaaatatgatattcaacttctagaaatccatttcttgtgttgaattttgaacacacctttttaaaattgggaaaattattttcccttaaaatgacctcaacatgagtgtgctttgaaaggcaaagtatttcattaatccagtgagtacatataattaaccattgttgagaaggatcttaggtaaagtctaactgatggtttttatttttgtgactaggtagctaggaccaaatccccaagtttgaaaccaggctgatgataatggggactcttctacatgagatagctttaaggatacacacacattaaaaaatatatatatatatgtgtgtgtgtgtgtgtgtgtgtgtgtgtttatgaaatatgtgaaatacaccgacattcttagatgctaacagtgactgcctaggtgctgtctcatgtttctgcttagcctttagtagtgactttttattaggctaaaacctgattaacttttaaattttattggagtaaaacctgattaattttgccttgacctacttaaatagttaaaatgtgtagtttaaacatgcatttcttaaggaacttcaggtgctttatattaggtgttaagtatcttatagtcaacctcatcacccttaatttcttcatttgtaaaatgagaataaaatgccatccattatggaaaataggaacacagactcaaaatttaaaatacaactttatcagtttctaagaacagtatgcaggaagagggagtatatgcatatagcttgaagagtttaaacttcctcgacttatggacccatcaaaattattggcttttgagacaattcgagaccctttctgggaaggaattgggttagttagcagaggtggggagactttgtgacattcaggtaagggagaagagttgaagtcctctggcattctgcagagaagagatcttgaagtcagtaacacacctcagaagctctgtgtaaaaagtactgataacaagcttttggaagagttacagtatttgtccagcagtgaggggcaaaacataagggtcttcacagacttttccttcagctcgtagttgtcattaaacatgtaactctgtctattgtggtggcaggtttcttcacaatctcttagggtagttttgagtattccagaaaataacccacgtaagatacctggcacacacttggcacctaggctgagatcagtattagtaccttgctttcattttctccctataacctagaaccatttcaggaaaagcagaatgccattgagcagtttattttctttgaatgttcttactgcccttttctatactccggtatcatgagatcgtgacattcgttcactcattcactaacagttcactgttcccttgtgagttggaacagaaaagtggtggaagcagtgacttagtcctttcatttaggattctgctgggcatcgttcatcatttaggattctgctgggcattgttcgggaaaatagacatttttaaaactcgtttcacttttttttaacatggtgactattcatttttctgcctcttaggttaatatttcagaaaaatacagataatggaaaacatttgaaatcggaaattatacaaaatatttagtttcagcatttgtgtacacattgccaggttggaaacaagagaatataagaatggaagccctcttgaatggtacaaaaaaattcaagatgctaagctgctaagttctgggttaattgaaaaaaaaagaaaaattcaagtcgcaatgtgtaaaacacaaattgtaactgtagtagcattaaagttagtaaattaggaatgtatatgctaaaacatgctatttgtcatttagaaaaaggctgggattggtatgtgtgtgaaggtttccagtatattctttatcaacaagcagaagccttaaagaaccttggagtaggcccagagttaaaggtaagtacatttgtgactagatgttagctttacatatttttgtttaaagaacagtaagacttatagtggaactaaggagaaatcagtagtaacactagggctactggaagaataatttttctgatgtttttgctttaatccttttagtaggttagcagttctggaagtgtgttctacaggatgtaaataagcaatacatccaaaagaaaaatttaaaggttttagtcttcagatacttaggaaacaacaggttaaacaaagtaaaactcaaataactttgggggtttattagtaccttttgtgtgttaatgtgcttgtttaatttccagggaatgtcctgtgtgttattcacaatttgagaacaaaatcgtttggtgtatgtacataacgtccatcaggacttgagttccacagaatgcactttggacagcgatatgctaaaccagtcgttcacctgagtgcatcagaatcacctggagtgcttgaaaaaacaccaatcactggaccttaatccccgaatttctgagttagtatgtctggagtagagcccaagaatgtgcatttctaacaagttcttatgggacacccatgcttctggtctggggaccactctttgactttgctgccttcctggagcaacacagtatttctgcaattatttgaatttcatattccttcatctagtaaaagtcatttaaggaatgctttaaaaagccagttatttagcaacaagttgttcacttgcttcatatgcttcattggaaaccaagtgttgagaggtccagcctagttggggagagggatttatgcatatgtgaaatgaatagacatgaatttatatggtgatatgctaagtgatttttttttttaagagacggagtctcgctctgttgcccaggctggagtgcactggcatgatcttcgctcactgcaacctccacctcccgtgttcaagcaattctcctgtctcagcctcccgagtagctgggactacaggcacacactgctatacccagctaattttttctattttagtatagatggggtttcaccatgttgctcagcctgggctcaaactcctgagctcaggcaatctgcccatctcggcctctcaaagtgctaggattataggcatgagccccagcacctggccctcataagtgatattaaaggcaaaaaaagaacagagaaagatcaacatgggctgcagtcaccaaggaaagatttgtagaggagcctttgctgttcaaactggtggttggggcaagtccaaacagaacaaccacgatttcagtgcatggcctaaatggatgctgggcctaccctgaaaggcgttaagaattaaaaattcagaagcatgaagcaacagaggctaacccataatagtcattgcattaggtatgatagctgatagtgggggggttgtgatctgatttctgcttacatagtcattttatgtataaatgtttagaaacagttttatatagttacactatatagctgtagcagggtttgttcctatgtagctttatgctcacctcattaggggttaattctgaaaacaatttttctgaaattagccaatgagcataactgtttagacctgatcagttgagtggcattatgccatgtacacaggctccagaatcagaactgactccaaatcctattgatagtttttctgcttaatggctgggtaatcttggacaagttattcagtttcttcaatggtaaaatgaagctaatagctgtcttacaatattgtgttggagctaagggatacctggtacctagtagatgacgaataaatggaaaagtctttctgtttgctttttttttttctttttcagacagggtcttgctctgtcacccagactggagtgcagtgacctgatcatggctcactgcagccccaacctcctagactcgagtaatcctcccacctcagcctcccaagtatctgggactacaggcatgtgccaccatacctggctaactttttgattttttgtagagatgaggtctcaccatgttgcccaggctggtttcgaactcctgggctcaagcagtttctcctgccttgaagtctggggattacagtagtgagccaccgtgcccagccggaaaagttttttgtttagtttcactatcacttgggactggttagtaaacctggtaacagctttgcccctaactaaaagtgtagtcatgtatcagttgctttgtactctgatccttaatttacttaatatgcagaagaaaaggactcaactcggtgattttaatgtctttctctatctaaaattaagaaggattttttcagcatttctcatgtacctgacactatgatgatattataattctttttaaggaaaggcaggtaagaatacatttagatggaagacttaaccagccctccaggtgattctgatgcacacttaagcctgagaactactggttcaacatactaatccctagtgtgcattttgtggaactcaatgttctgatagatgctacatacagaccccagagattttgttctcaacttgtgaataccacataaaacatttactggaaatttatatgtaagttaatatttaaagtacaagagagctgtggtgtagatgtgcctgtacatttgttgtcataacctgaatcacccaccactcatttcccttccaccttagaacgatgttttacataatttttggaagcgctaccttcagaagagcaagcaggcatattgtaagaacccagtttataccactggaaggaaacctacggtaagtcacaagtctgaaaagttggattaaaaaacatgtctgttgagatgtagagatgaagatgggttcatgaccagtttgagtatctgagattatgatgcttgtcagaggattttcagttaagaggcttctgttacagtctagaggacggggtcactgatttaaacgttggaataaagttttttcttcacttttttcctgcagtatggaattaattttgacatcttatcagactagttgaaacataaaggaatttgtggttgattttctagatagaagatagtttctatcactgtactattaaaataatttttaatttaataatgtatttattctgtttgcttggaatacctacttactttatgtggcatttcaagattcagctcagttatcatatcttctcagaagcctttatgtgaagaaaaataaaatctgggtattctcccatatccaccagctgtttttagcagtttctttgtaactgctttataaatgtgccatgtaacattttatttggggtcgaggatgattctacttctaagaaaagcaagtttgataattttttttgttcatttgtttggtttttttttgagacggagtttcactcttgttgcccaggctggagtgcaatggcgccatcttggctcactgcaacctctgccttcctggttcaagcaattcttctgcctcagcctcctgagtagctgggattacaggcgcccgccaccacacctggttcatttttgtatttttagtagagatgtggtttcaccatgttagccaggctgatcttgagctcctgaccgcagatgatccatcctcctcggcctcccaaagtgctgggattacaggcgtgagccactgcgcccagccagttggataatttttgatgtgtggtacagatgccccttgccatggggtcacatcccgataaacccattgtaagctgaaactatcattaagttgaaaatgcaggctgagtgttaatgactcatacctgtaatcccaacactttgagaggctagggcaagaggattgcttgagcccagaagttcaagaccggcctgggtaacataatgagaccccaactctacaaaaaattaaaaaatacgtactgggcatggtgacacatgccctatatagtcccagctacttgggaggctgaggtgggaggattgcttgagcttaggaggttgaggctgcagtgagctgtgatcacaccactgcactccagcctgggcaacagagtgagacttgtctcaaaaaaaaagaaaatgcatttaatatacccaacctaccgaacatcatagcttagtctagcccactttgaacatgctcaggacacttacattagactacagttgggcaaaagtcatcaaatacaaaacctattttataataaagggttgaatatctcatgtaatttattgattactttactgaaagtaaaaaacagtatggttgtatgggtgcttgaagtatagttttgactttgtgcatattgcttgcaccgtagtaaagtcaaaacatcacaagtaagggaccatctatagttactcttcatatggctagaagagattctgaatctgtttgatacacatttgttaagggcttgggaatttggcccagtgtttccttgtttgcttgggttctcataggtttcacatccagagttgagagacccagtactgagaaacccaggtctgggtgaagagtaggttacagagatgagcaaaagagataacctctgagctccttcagtatcctcatgtgataccaatcctaagaatgagaagtttagagtagtcaagtcgtacgggatagtgatggttaaatgttatcctggcgggcagttgtgggggccaacctgagaaagctaactgaaaaaaaaaaaaggcaggggaataacctgaggggttcgtttggagaatgttttaaaatatgagataatgaatttaaataaactcaagagaaataacttgaatttactagaaaagataatattttataatcatagaactatgaaacattatactgtcttgatacatgagagagatacttcccaagaaaatcggaagatgctatatggttctaaggtaacactttgaaaaagaaaggaaagaattgcctaaactactaagaacctgatctttaaaatttcatatctaaggtatttgttgattgtatttatgccctgggagtttgcctaacacatagaaaatatgcatcagaacctgggattctctgacatttaaatatttttgggttaacttaagttttttttaaaaaaaggtttttctagagttgagtaaattctcgtgtaaagcaatattagcatcacgctaaaatcttggtgaataaataagcaataagtaaaatattaagctgatgtatgaattagtaaggtaatttctacttcaagagtacagctatactctattttgaaaggaaatggaaacaattacttttaattagaagcatagttttctcaagtatatccattaaatatttccttagtgctttggagataactgttttgagaacagtaagaggcctggtccctgcttttgagctgtattatcttgggtgaggtaaattactgaaaatgtgcagaagaagcaaattaacaagcaaatatagagagggggacactggggaagggtgctatttaataaaaggtggtcatggaggcccttgctgatgtgggagctgaagtgatgaagaaagtgagagagtaaaccatgggatatctagggcaagaaatgcagaatttcaggtcttaccaagaccagttgaatgcagatacgcattttaagaagtccgtagatgcttcctatacacagtacactaaagtttgagaagcactggtgtagatgagaagtgatggtggctggtaccaggtggtagaactggaggtgataagtgataggattctatataaagtctgaagatagagccaacagaacttcctgacggattggatgtgagagaaagagaggaataggagtcaatgatgactctaaggattttgacctaagcagctggaaggaaagagttgccatcagctgaagggtaagtgggccaggaaggtcagtggttccattttggacatgttaagtttgagacagctgttagcatctattagtccattttcacactgctataaaaatactacctgagacagggcaatttctaaacaaaagaagtttaattaactcagttttacatggttggggaggccctagaaaacatgtaatcatggccgaaggagaggggaagtaaggcatgtcttacatggcagcaggagagacagagagagtgcgtgcgtgtgagcaagcccatgcagggggaaactgccactttaaaaaccatcatattgcatgagaactccctcgctatcatgagaacagcatgggggaagccacccccatgatccagtcacctctcaccaggtccctctcgcaacatgtggggattacaattcgagatgagagatttggatggggacagagccaaaccatatcattccacccctgccccctgccaaatctcatgtccttctcacattgcaaaatcaatcatgccttcccaacagtctaccaaagtcttaactcattccagcattaactcattaactcaaaagtccaagtccaaagtctgatctgagacaaggcaagtcctttctgcctatgaacctgtaaaatcaaaaacaagttagttacttccaagatgaaatgaggttacaggcattgggtaaatgttcccaatccacatgggataaattggccaaaacaaaggggccaatacaagtccgaaacccagcagggcattcactaaatcttaaagcttcaaaataagctttgactccatgtctcacatccaggcatgctgatgcaaggggtggtttcacaaggtcttgggcagctttgctcctatggctctgcagggtacagcccccaaggctgctttcatgggccagagttgagtgtctggctttccaagtgcatggtgcaagatgtcagtggctctaccattctgggatctgcaagacgatggccctcttctcacagctccactaggcagtgctccagtgggaatctgttggggctccaaccccacatttctcctctgcattgccctagaagaggttctctatgagggctctgcccctgcatcagacttctgcctggacatccaggcatttccatacatcctctgtaatctaggcagaggttcccaaacctcagcccttgtcttctatgcacccacaggcccatcgccacgtggaagctgccaaagcttggggcttgcaccctctgaagccatggcctgagctatactttggtgccttttagccacagctggagctggagtggctgggatgcagggcgccatatcctgaggctgcacaaagtaactgagccctggacctggcccgtaaaaccatttttccctcctaggcatctgggcctgtgatgggaggggctgtctcgaagatctctgacatgccctggagacattttccccattgtcttgactattaacattcactcctcattactaatgcaaatttctatagccggcttgaattttctccccagaaaatgggttttccttttttaccttgtcgtcctgctggaaatattccaaacttctatgctctgcttcccttttaaataaaagttccagtttcagataatctctttgtgaacacacatgactgaatgctttcaggatcagccaggttacctcttgaatgctttgctgcttagaatttctgccagataccctgaatcatctttctcagcttcaaagttctgcagatctctagggcaggggcaaaatgccaccagtctctttgctgaaacatagcaagagtaacctttactccagttcccaataagttcctcatctccatctgaaaccacttcagcctggacttcattgtccatatcactatcagcattttttttttttttttttgagatagagtgttgctttgttgcgcaggctggagtgcagtggcaccatcttggctcattgcaacctccgcctcctggattcaagcgatttttgtggcttagcctcccgagtagctgggactatagatgcatgccaccatgcccaactacttttttgtatttttaatacagatggggtttcactgtgttggtcaggctggtcttgaactcctgaccacaggtcaggcccacctccacctctcaaagtgctgagattataggcatgagccatcgcacctggccgctaacagcattttgatcacaatcattcaacaagtttctaggaatttccaaactttctttcatcttcctgtcttcttctgagccctgcaaactgttccaacccctgcttgttacccagttccaaagttgcttccacattttccagtatctttatggtggtattccactcctggtaccaatttcctgtattagtttgtttccacactactatgaagatactacctgagactgggtaatttataaacaaaagaggtttaatgggctcagagttctgcatggctgcaaggcctcaggaaacttaaatcatggtggaaagcaaaggtgaagcaaggcatgtcttccatggcagcaagagagagagagtgtgcagggggaaatgccacttttaaaacagtcagatctcatgagaactccctcactatcacaagaacagcatgggggaaactgcccccatgatccagtcacctcccactaggtccctccctccagacatggggattacaattcaagatgagatttgggtggggacacagagccaaaccatatcagcatccaagaggaaatttcaagcatgcagttagatgtaaaagtctgcagttcaggagagaggtctgagccggagacataaatttcgaagctgttagtttatattataatcatgaaatctaacatgctattgtttgtaacatacgccattattttaagtactgctaagaaagaaaagagtgctacaaattcaattttgacatgccagtgattgtaagataaatcttgatttctaggatgttaaaatgtggtatgggaggggacattttaaaatttgaagatagtagctagtatttaaaactgtaagaccggatgacatcaccaaggtatgaagacagagagaggaccaataacttagccctaggtcattctacggttaagatgtttgggataaaagaggaactggcaaaaaaattcttgggaacaatgtgaagtaagaggacagctgagagaatgagcactctggaaaccaagggaacaaagtgtttcaagaagagggcagtgatcagctgtgataaatgctgtcactaggtcaagaaggaagagggctgcaaagtggttagtggagcagtgggatcaaaaccttgattggaatggaatataaggtagactgagaggagagaaattggagacaacaaatttggactttttcaaggcattttgctgcaacaagtacaaagaaattgcatggttgctggggtcaagggagagcttttaaaaagtgggatagaggggtggagccaagatggccaaataggaacagctccagtctacagctcccagcatgagcagcgcagaagacgggtgatttctgcatttccaactaaagtactgggttcatctcactggggagtgcgggacagtgggtgcaggacagcgggtgcagcacaccgtgcatgagccgaagcagggcgaggcatcgcctcacccgggaactgcaaggggtcagggaattccctttcctagtcaaagacaggggtgacagacggcacctggaaaatcaggtcgctcccaccctaatactgcgcttttcgaacgggcttaacaaacggcacaccaggagattatatcccacacctggcttggagggtgctatgcccatggagcctcgctgattgctagcacagcagtctgagatcaaactgcaaggcagcagcgaggctggggaggggcgcccgccattgccgaggcttgagtaggtaaacaaagctgctgggaagctcgaactgggtggaacccaccacagctcaaggaggcctgcctgcctctgtaggctccacctctgggagcagggcacagacaaacaaaaggcagcagtaacctctgcagacttaaatgtccctgtctgacagctttgaagagagcagtggttctcccaccatgcagcttgagatctgagaacgggcagactgcctcctcaagtgggtccctgatccctgagtagcctaactgggaggcaccccccagtaggggcagtctgacacctcacacggccaggtactcctctgagacaaaacttccagaggaacgatcaggcagcagcatttgcggttcaccaatatccgctgttctgcagccactgctgctgatacccaggcaaacagggtctggagtggacctccagcaaactccaacagacctgcagctgagggtcctgactgttagaaggaaaactaacaaacagaaaggacatccacaccaaaaacccatctgtacgtcaccatcatcaaagaccaaaggtagataaaaccacaaagatggagaaaaaacagagcagaaaaactgtaaactctaaaaatcagaacgcctctcctccaaaggaacgcagctcttcaccagcaacagaacaaagctggaaggagaatgacattgacgagtcgagagaagaaggcttcagaagatcaaactactccgagctaaaggaggaagttcaaaccaatggcaaagaagattaaaaaccttgaaaaaaaaattagacaattggctaactagaataaccaatgcagagaagtccttaaaggacctgatggagctgaaaaccacagcacaagaactacgtgaggaatgcacagtcctcactagctgatgcaatcaactggaagaaagtgtatccatgatggaagatgaaatgaatgaaatgaagcgagaagagaagtttagagaaaaaagaataaaagaaacgaacaaagcctcccagaaatatgggactatgtgaaaagaccaaatctacgtcttattggtgtacctgaaagtgacagggagaatcgaaccaagttggaaaacactctacaggttgttatccaggagaacttccccaatctagcaaggcaggccaacattcaaattcagaaaattcagagaatgccacaaagatactcctcgagaagagcaactccaagacacataattgtcagattcaccaaagttgaaatgaaggaaaacatgttaagggcagccagagagaaaggtcgggttacccacaaagggaagcccatcagactaatagctgatctctcggcagaaactctacaagccagaagagagtgggggccaatattcaacattcttaaagaaaagaattttcaacctataatttcatatccagccaaactaagcttcataagtgaaggagaaataaaatactttacagacaagcaaatgctgagagattttgtcaccaccaggcctgccctaaaagagctcctgaaggaagcactaaacatggaaaggaacaaccggtaccagccactgcaaaaacatgccaaattgtaaagaccatcaaggctaggaagaaactgcatcaactaacgagcaaaataaccagctataacatcataatgacaggatcagattcacacataacaatattaaccttaaatgtaaatgggctaaatgctccaattaaaagacacagactggcaaattggataaagagtcaagacccatcagtgtgctgtattcaggaaacccatctcacatgcagagacacacataggctcaaagtaaagggatggaggaagatctaccaagcaaatggaaagcaaaaaaaggcaggggttgtaatcctagtctctgataaaacagactttaaaccaacaaagatcaaaagagacaaaggtggccattacataatggtaaagggatcaatgcaacaagaagagctaactatcctaaatatatatgcacccaatacaggagcacccagattcataaagcaagtccttagttatccacaaagagacttagactcccacacaataataatgggagactttaacaccccactgtcaacattagacagatcaatgagacagaaagttaacaaggatatccaggaattgaactcagctctgcaccaagtggacctaatagacatctatagaactctccatcctaaatcaacagaatatacattattttcagcaccacaccacacctattccaaaattgaccacatagttggaagtaaagcactccttagcaaatgtaaaagaacagaaattataacaaactgtctttcagaccacagtgcaatcaaactagaactcaagattaagaaactcactcaaaactgctcaactacatggaaactgaacaacctgttcccgaatgactactgggtacataacgaaatgaaggcagaaataaagatgttctttgaaaccaacgagaacaaagacacaacataccagaacctctgggacacattcgaagcagtgtgtagagggaaatttatagcactaaatgcccacaagagaaagcaggaaagatctaaaattgacaccctaacatcacaattaaaagaactagagaaacaagagcaaacacattcaaaagctagcagaagacaagaaataactaagatcagagcagaactgtaggaaatagagacacaaaaaacccttcgaaaaatcagtgaatccaggagctggtcttttgaaaagatcaacaaaactgatagaccgctagcaagactaataaagaagaaaagagagaagaatcaaatagacgcaataaaaaatgataaagggaatatcaccaccgatcccacagctaccatcagagactactataaacacctctacgcaaataaactagagaatctagaagaaatgaataaattcctcgacaaatacaccttcccaaaactaaaccaggaagaagttgaatctctgaatagaccaataagaggctctgaaattgaggcaataattaatagcttaccaaccaaaaaaagtccaggaccagatggattcacagccgaattctaccagaggtataaggaggagctggtaccattccttctgaaactattccaatcagtagaaaaagagggaatcctccctagctcattttatgaggccagcatcatcctgacaccaaagcctggcagagacacaacaaaaaaagagaattttagatcaatatccttgatgaacattgatgcaaaaatcctcaataaaatactggcaaaccgaatccagcagcacatcaaaaagcttatccaccatgatcaagtgggcttcatccctgggatgcaaggctggttcaacatacaaaaatcaataaacataatccagcatataaacagaaccaaagacaaaaaccacatgattatctcaatagatgcagaaaaggcctttgacaaaattcaacaacgcttcatgttaaaaactctcaataaattaggtattgatgggacacatctcaaaataataagagctatctatgacaagcccacagccaatatcatactgaatggacaaaaactggaagcatttcctttgaaaactggcacaagacagggatgccctctctcaccactcctattgaacatagtgttggaagttctggccagggcaatcaggcaggagaaggaaataaagggcatgcaattaggaaaagaggaagtcaaattgtccctgtttgcagatgacatgattatatgtctagagaaccccattgtctcagcccaaaatctccttaagctgataagcaacttcagcaaagtctcaggatacaaaatcaatgtgcaaaaatcacaagcattcttatacaccaataacagacaaacagagagccaaatcatgagtgaactcccattcacagttgcttcaaagagaataaaatacctaggaatccaacttacaaggcatgcgaaggacctcttcgaggagaactacaaaccactgctcaatgaaataaaagaggatacaaacaaatggaagaacattccatgctcatgggtaggaagaatcaatatcgtgaaaatggccatactgcccaaggtaatttatagattcaatgctatccccatcaagctaccaatgactttcttcgcagaattggaaaaaactaaagttcacatggaaccaaaaacgagccctcattgccaagtcaatcctaagccaaaagaacaaagctggaggcatcacgctacctgacttcaaactatactacaaggctacagtaaccaaaacagcatggtactggtaccaaaacagagatacagaccaatggaacagaacagagccatcagaaataatgctgcatatctacaactatctgatctttgacaaacctgacaaaaacaagcaaaggggaaaggattccctatttaataaatggtgctgggaaaactggctagccatatgtagaaagctgaaactggatcccttccttacaccttatacaaaaattaattcaagatggattaaagacttacatgttagacctaaaaccataaaaaccctagaagaaaacctaggcagtaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaacctactcatctgacaaagggctaatatccagaatctacaatgaactcaaacaaatttacaggaaaaaaacaaacaaccccatgaaatgtgggcaaagggtatgaacagtcatttctcaaaagaagacatttatgcagcccacaaacacatgaaaaaatgctcatcatcactggccatcagagaaatgcaaatcaaaaccacattgagataccatctcacgccagttagaatggcgatcattaaaaagtcaggaaacaacaggtgctggagaggatgtggagaaataggaacacttttacactgttggtgggactgtaaactagttcaaccattgtggaagtcagtgtggcgattcttcagggttctagaactagaaataccatttgacccagccatcccattactgggtatatacccaaaggattataagtcatgctgctataaagacacatgcacacgtatggttattgcggcactattcacaatagcaaagacttggaaccaacccaaatgtccaacaatgatagactggattaagaaaatgtggcacatacacaccatggaatactatgcagccataaaaaatgatgaattcatgtcctttgtagggacatgggtgaagctggaaaccatcattctgagcaaactatcacaaggacaaaaaaccaaacatcgcatgttctcactcataggtgggaattgaacaatgagaacacatggacacaggaaggggaacatcccataccggggactgttgtggggtgggtggaggggggagggatagcattaggagatatacctaatgctaaatgacgagttaatgggtgcagcacaccaacatggcacatgtatacatatgtaagaaacctgcatgttgtgcacatgtaccctaaaacttaaagtataataaaaaaatttttaaataaagtgggataaatgatagcatatttgtgtagtgataggaatgatgcaggagagaagaaaaatttgcaatggagagaaagagtagatgtgaatctttgaacagatatctttgagtgtacagagaggtgggatcaagtgcacaaatagagaaactggctttaaacaggagtttgaatcgtccagaagaatcaggcagaggcagagtatgtggtagagttgctggcagtggtaacctgtgggaacctgtggaagttttctctgtgttcatgctcatcagccagctttctggtgtagcctccttctcacagggcttccctatagggaggggatatgcttgacagaggacacaagcatcttacttcattctctgaggtttttgtttgtttttttgtttttttgggttttcttgcttcattgtcttgtgagcctctttaccaggagtcttagtcttatcttcctgtaataagatcaagtttcttggcctgcagggttgaaatcatggctttttgactgtgatcggtttgcctgggtaatgtcagctaatgaggtctttaggtagccagccagctgacctttttagggacactctgttgtttcaacagtacatgtgtgaacagttaaacagtagtatgagatagtatatccttgttgattacatgttacaaatcgtatatgctacaggagttcaaggaaaggagaaatcactgaagagtgggttggaaagatggcatgatgagtaagtaatgagttagggagagggaggaaaaggcgtagttcaggcaggagaaccagaattaacaaagatacaaagcaaaaattccccaggtaggtttggtaaaaagaagccagccagcatgtgtggggtcattgatgcgcgatgttttcagtggtgaagatattagcgctgtaagagagatgttcatggaagaaggagacctgatggcagggctggcagccggtttcctcgcccatccttgtctgtgactcctctccaagaagcactgctgggagctgtcaggagcgtgtttcagaagtaaagggacttggcaggcagttgcagttttctagagtggtttcttttagggtgtttgtgataggagttgtttaagttcacagaaattaactgtttaaaactgttacacaataattttatttatattgttttgcaaacaggtattagaagataatctaagtcattcagactgggctagtgagcctgagctgctaagtgatgtcagctgtcctccttttcttgaaagtggagcggagtctcagtctgacatccacactcgaaaacctttccccgtcagcaaagcatcacaatcaggtaaaaatgagaaccaaaccatttcgaattttaaagctgttatgccccttaaaaataatttagtctaatcttctgataatccaaggaaagggaacttggtctagcgaggaagaatctagcaaggaagaatgacttgctgaatcatatggctaagacaaactaagtgaaatcttagcgcaattttttaaaaggcacattgtctccatgtgagttttttgtgtgtgattttaaagggacataaagttcaagtggatccagaaagaaggaggctgcttcagaaagatctatatgtgtgggctcagcgtcttcaaagaaaagttgtagcagaaaaatgttattatgtagccatatagtaaaatagacaaagatggtatgtccagtttctaagcatagactaaatcaagctgagtaaaatttaccttgttacatgtgtgttttactttctgatataattccataacttgaaataaataaggaatgtatttaagattaaaatataggccttcattcctttatcagtgtatccacatctcttcctggactgcacagtgacacagatatcaaataagttacttttggtgtaaagtgttaggatcattgactaattgggcaacaaggaatttctggagttttcttctccaccttttcagacaagcctgagctcaaatattcccagaagaccatgactgtaaaaccatcgaacctttttgaaagaagatattagctccttttaaagcatcatgattgttttgtttacctatgtgtaacagttttgtttgcttatttttttttgttttgttttgttttgtttttgagatggaatctagttctgtcacccaggctggagtgcagtggtgcaatctcggctcactgcaacctccgcctcccaggttcacgtgattctcctacctcagcctcctgagtagctgggattacaagcatgtaccaccacaccctgctaatttttgtatttttagtagagatggggtttcaccatgttggtcagactggtctcaaactcctgaccttgtgatctgcctgcttcagcctcccaaagtgctgggattacaggtgtgaaccaccgtgcccggcctgcttatttgttttttaataaatgatgatccctagagctttcttttagtttttacattaaaagtaatcaatggccgggcgtagtggctcacacctgtaatctcaggactatgggaggctgaggcgagcagatcacttgaggtcaggagtttgagaccagcctggccaacatggagaaaccccatctctactaaaaatacaaaaattagctaggcgtggtggtatgcacctgtagtcccagcttcttgggaggctgaggcagaattgcttgaaccgggaggcagaggtttcagtgagccaagatcacaccactgcactccagtgtaggtgacagagcaagactccatctcaaaaaaaaaagaagtaattattagtgaaactcaatataaaactataaaatgcagatagtcacgaagaaaataaaatcaccagttactgtaccaactagaaattaccgctactgctattgtagatcattccagaaagtttttcttcatgtatgtatacggaaagaatttattttgtttttgtaaaaatttgaattatttcttcattctttaaatttttaaaaacttaaagtataataataaataaatttttaaatcaaaactctacaaatcattctataagtcttgttataaaaaaatcgtaaaaataaaaaattgttttaagttgtagtccaccagtcacggcagtggactacacctattgtaatcccagcattttgggaggccaaggagggaggatcagttgaacccaggagtccaaaaccagcctgggcaacatagtgagacctccatctctcaaaaaataaaaattagctaggcatggtggtgcatgcctacagtcccagctactcaggtgactgaggttgctggagtgcttgagccaggaggtcgaggctgtagtgcgctgtgatcatcccactgcactctagcccggccgacggagcaaaaccttgtcttaaaaaaaaataaaatttgtagtctaccttcagctaatgtcctgttcccaaggggcattcattttcaactcttttgtgactttcatatttccgtatcacgtgcttctagtattacatcttgatttctagtttgggacattagctattcaattctgttttagctctttcacacattcctcactgtcccttatctgcacatagtccccagtacatgcatgtgcatttctcattctctctcttctcaatataattgctgtaattttttactagatcagtatttactgcttaaattattataaatgtatacacattatttagactgagctgtatagcttactatgattactttttctgtatatcctgtggttttcttggagttgataattgttatttatttagttttctgtttattactaatccataatttattactaatgtatctccacacttccagttcttataatctcttaatatcttatgcattctatcagtttcatcttctggaagaagtctccctggagcctctgatctgctctgatctagaatgatatctctagacctgtggcctggctgactttaggatctctccttttttgttgttgttttttttttgagatggtgtcttgctctgttgcccaggctggagtgcagtggcacgatcttggctcactgcaagctccacctcctgggttcatgccattctcctgtctcatcttcccgagtagctgggactacaggcgcccgccaccatgcccagctaatttttttttgtatttttagtagagacggggtttcatcgtgttagccaggatggcctcgatctcctgaccttgtgatctgcccacctcggcctcccaaagtgctgggattgtaggcgtaagctactgtgcctggccaggatctctctttaccaccatcctgagattctgtcatttttcttttgttggaattttttattttctgcatcccatttcttctttcctggattaccctctcatttttgtggagcatcttttatttcacagagaatattaacgatatttcatgcctgacttgattgttttggcctctgctttttacatgaaaggcttcaaatgtttagtgagcctaagatagctattcttacttaaacatgggagactaaaaagttgataaaaggctttgtttccgtggttagtcttgtcagctctgctctgcttgcaaggttattttctcagtgaaccccagcattatcatctttaaatcttttccccccgagctgatcagattcctcagagaaatctctttgagtcttctgtttggcgggtttgtaatcttggctgtcactgttctggaaactgggtaggaagaagaagaccggaggggaatgggggattgttttagtattcagtatgtaaactttcacttaagcctcctgttttcacttctcaacagtgcatgtgagtggcatgccttattctagagacccttctctctggagaagaaatttccagtttttggccaagactagggaggggcatcacttggctgcatggatttgggataagaatctggatgtctggctgggtgtggtggctcacgcctgtaatcccagcactttgggaggccgacgcaggcggatcacgagggcaggagattgagaccatcctggccaacgtagtgaaactccgtctctactaaaatacaaaaaattagatgggtgtggtggcgcacgcctgtagtcccagctactcaggaggctgaggcaggagagtggcttgaacccgggagttggaggttgtggtgagctgagatcacaccactgcactccagtctgggcaacagagcgagattccatcttaaaaaaaaaaaaaaaaagaatctggatgtctaactgcttcttaatctggattttaagcagtcatcctggtgttaggcctgccttcatccagtttctaggggtatgagtttctccaattcctgagccttctttagggatccccagtgaaaactgctttttggcatattccccactgctgactttgaatctagctttcccaggactgctaagccaataatcacctatctgtatgctttctgacttctaaaattttattgttcttgtcacctttttcatgttatttgtcctcaggtttacatgtttaaaaaattctctttataattgttgtagcaggagagagcagaggctaacgtgttttcaatttgccaccttaactggaagtccttacatattataaggaatatacaaaaaattgtgtgtgtgtacacaacacacatttattttatggaaatctgtgactttatatattcatttaaaaccgatggtccttaaactttagcatccatcagaatcacctgaagagcttgttaaaccttagtaatttgcagttccattacgttctcaggtgatactaatactgctggtccaggagtatactttgagaaccactgatcttaaagttctatggacattgttttgtagtataccattgcatggaattacttaattaaacttctattcctggcatttaggttgttctaaatttttatattataaacagtgctgccacagcattccttgacccgaaacctttgcatggctttcaaatcatttcactgggatgaaatcttcaaagtagaactgttgggcctatttgcacatcaggtttctactctgtgctagagactgttctgggcactgggacataatggtggcaagactgtccgccttcagggtgtttatattgtagtaggaggagataggcaataaacgaccaaataaagaacattttagtcactgataagtgctatgaagaaaggacttacagaatttggagaaagggattttgaggagttattttgagactttgtgtttaagaaagtgtagcttctcagggtcattcctagtcctgctgcttttctacccttactccttatgtgacttcacctaataccatagctttaaccaaccaccaactatatgctgaaactaaaattcctatctctagtcccacctctccttcaaagtatagattcttatattcagctgctgactcaacatttctgttggtgtatttaataagattcacacttaacacacataattctaacattgatttcgctcatcaaactggattttttttttttttttttttggccatcttccttgtcttggtaaatggcaatgcattctacttgttgctcaggccaacaaccttataatcatacttgttttcttttctctcatgctttacatccaatctatcagcaaatcctttgactctgcctttaaaatctatctagaatgcaaccatttctcaccagctgcaatgctaccgctccagtccaagtaccagtcatggctttcctggaagagtggtcttctgtttctactcctgccctcccgtaactccattcttccctcagcagctggagtgacctttttaaatacataaatgaggtcctgttgcttccatgttttaaaactctccagaaacttcttagaataaaatccaaagtacaaataatgacctacaaaattctacataatgtagttcttaatctctcttcagtatcattcccaccactttccctcagaaatttctgttcttataaagagaaagaggttgaatggactcatcgttccacatggctggggaggcctcacaatcttggtagatttacgtagaaactatattatgttgcatcccatgatgctctcactacactggcctttttgctgttcctgcagttcactcctgctaatatacttggtattcttcccaacatccttaagacttactttctgaattaattcaggtctctgctcaaatatcaccttctcaatgaggtttctctgacacccatataaagtagcgcatctctcttcccttcccatcacttactatgactctacattgctatttttctatgtagcatcactatctgtcaaatgtaatttttttttttttagagaaagtctctccgtgttgcccaggctagtctcgcattcttgggctcaagtgatcctcctgtctcatcctccctagtagctgggattacaggtgcacaccatggcacctggctctgccaattgtatttcttgtttgtttgtttattggtctgtctcccattactagaatataagttctaagagagatgagacattattcacttgtcatttcctgagacatagaagagtggcacaaagaatgagatgaataagcatctggtgaatgaatgaagataccataatgtcatatggtagaggatacctgaaagatggggatagaagaaggtgctgctctagctaagttttggagttttggagaggccttgtagagaaggggacatgggagttgaggtcagagtcaaagcagttacacatcttttgttgtgcattgtaattgtgtatcctttcctttatttaaaaaattggtttatgttcactattaaaaaattcaaacgttcaaattctttttttttttttctttttggagacagagtcttgctctgttacccaggttggatggagtgcaatggcacgatctcggctcactgcaacctcccaggttcaagcaattatcctgtctcagcctcccaagtagctgggattacaggcgtccaccactacacccggctaattttttgtattttttagtaaagacaagatttcaccatgttgaccaggctggtttcgaactcctgacctcaagtgatccaccctccttggcctcccaaagtgctaggattacaggcgtgagccactgtgcctggctcaaatccgtctttagaatcctgtcccatcccactcctacagatatcccatgattacgtttttggctgattttattctagtcctttattactctttattgccaaattgctctttgtaaaggttttataactagttttaagataattgtattagtccattttcttactgctatgaagaaatacccaagactgggtcatttatacagaaaaagaggtttaatggactcacagttccacatggctgggagtgcctcacaatcacggtagaaggtgaaggagaagcaaaggcacgtcttacatggcagcaggcaagatgagcgtgtgcaggggaactaccctttataaaactatcagatctcgtgagatgtattcactctcatgagaacagcatggaaaaaacccgcccccatgattcaattactttccccaggtccctcccatgacacgtgggaattatgagaactacagttcaagatgagatttgggtgaggacacagccaaaccatgtcaatatttaaaatgcctgtttagattttttgctgtttttcttttgttatccaaatagttcactggatttttaaaaatctccatttatctcctaagaaacgtctgtctgctctggatctctggatggagttgaatactcacaacgaaaggagaagggaatcgtgaagatgaccatgccacagacacttgccttctgttatctgtccttactttggcagagagaagcaataacactttcagatcttttgaggttagctagacctcttgtatgataatatttttgctggttactacatgaactaagtagacaaacttcggatattttgatttttataagaaggcttaacttgaggaaggaactggaaaggttgagtagcctgaattctaattctgaaatgtaatcccccctgggctagtaattcatcttcttgattttcttatttatgtagtagaaattatagtacttaccacacatgggctattggaaaattaattatctaatataatcttttgaagagaaaagtgacatttaagtacctgagtaatattagtaaatatttttcatttctaagaaaagataaacaggtgatctttacattagcaaaatggttatttgtagttacacaaaagcatatattggtgttaagagctaaaatataggttgtctatgtttgtaaggaaaagttgaagacaaaactgttgaaaggatgtgttatccagatagtaagcgtttatatttttcaggataatctacagagtgttttggttaatgaataaattacagttttatgtgtaagaatttctcacttaatagacgtgccaaaattcttatgtgctgatttttttctccttgctttatatgtgttctgaatagtaacatttgggtttaatcaatatgtagggtgcttttaacagcacaaattaggaaccaaactgctgggtttgaatcctggctttgccacttatttattatatgaccttgagtaagtcatttaatttgtctctgcttttgtttcttcgttggtaaaatggggctaataataactacctcatagggttgtaactactttcaataattagcgctacatggaaagcacgtagagcagtgtctggcacataataagacctcagtgctagtcattactgtttttgttttcatcatcaccaccatcatcgtcattattggctcagcccctttgattaaatgtaatgcctccagtaaatgatgatagtgcctttgaatttggccacatcaaccaaataaaaacgctttcctcaggtctgattaactctacaagcagatagcccatgattcagtgaattttactattaatttaaaaacctgatcttgttttgtatgcccccattgggtgatctcatcttttcccaacgctttaattaccactatactgatgactctcaaatttatatctctagcccagacttgtctactgagggccagacccatagattcatatatacagctgtctgctggacacagctacttagatgtctttatggtatctcagaatcagcatgactagaggttcatcatctgtctccttgatccagctccttttccagtgttctctttcttagtaaatgccatccaccctgttgcatcctatccagaagcctaggaatcatccttgactctttcccctctacgtacactgttggtcaattgtccactcagttatatgtccaaaaactcacagaaccattcttctctgcattccctctctctctctgtcctctctaccctcatttggattgcttaacagtctcccagatgagctctgtgtctgtaatcttgtgtcatttctatccattttcctcctgataaccagaaggatcttacaaaaacataaacctaatcatgtcattagagctggataaaggggctagccatcctacccaggacgatctataaggggctaacagaactctcctagaaatctaacaaggtggagaaagtcgtatttacctggaattcttctcagggagaatattatatgtggttggaataataggggtaagatactacccacccctcttctctccctccctcttttctcctctctctctctttccctctcctcccccaccaaggggaattctaaaatgccttcaaggagattaaatctagttagctagggggcttttgttttgctctgtggaatacacaagtttgggaacagagcttagttgcttggggctataggagaagagactgtcaccattgatattcttcctttgcttttctcccagaaagagctctaagtcataagttctcaaaatgtggcctcctgacttacagcttcagtatcacttgggaactggttcgaaatgtgaattcttagacctatcctacaccttctgaatcagaaaccctggggtaggacctgataatctctgctttaaaataagcccttcaggggattcttcttctttttttttttttttaattgtttatttttattttttcgtagagctggggtcttgtgatgttgcccaagttggtctcaaacttctggcctcaagcaagcctcctaccttggcctcctgccttggcctcccaaaatgttgggattatgtcatgagccaccatgcctggcccagaggattcttatggatggcaaagtttgagaaccactgccaaactttgaaaaaatatgtaaagaacacagttttaagggagtatgttattagcctggccaaagtacccacataccttaacactgtgcatgtcactccctttttaagtcctctagcagcatccatagtccttaggataaattcattaccctgcaaatagcctgtaagggaccctgcctacctagcaataatggcattaatgaataaaaatagccagcccttattcattctgtaaatttgtattgaatatctactatatgcaggtgttgttctggcatctagacccttgcgatgcagttgtgaatcatataggtcaagtccttgctctcacaaatttcaagaccagaggaggaaaaaacaaacacatacatatggttggtgcaaaggtcattgcagttaatggcaaaaaccacaattacttttgcactaacctgataaataagaaaaggatcagacagggaaaggctattcagaagattgaaataggatggtatgatagaaaatgactagatggctactctagattggttattcgggaaggcctcaccaagagggtggcatttactctgcaccttaaatgaaaatagagccagtgtgaatatcaggagtacaatagacctcacttaccacagaagatatgttccaagacattggatgcctgagaatgtagatagcacggaaccctatatacactatgttttttcctatgtgtacattcctatgataaagtttaatttataagttaggcatagtaagagattaacaacaatacctaataataaaatagaataattattacagtgtactggtactactactcttgagctttgaggctgttattaagtaaaatataaggggtacttgaatgcaagcactgcaacactctgacagtagatctgagaatgagccaatgaactacaagtaactcatggctgggtggcgctacagcttggctgtgctggacaaagagaggacccgcatctcaggtgggtcagagagagatggcatgatatttcatcatgttctttagaatggcatacaatttaacacttatgacttgtttatttctggaattgtccattgtatattttcagaccacaggtagctgaaaccatgcaacacaaaaaagaggatgagtggggactgctgtactggcattccgggtagaaggaggttgctagtgccaagccctaaagcaagagctgtgtgatgaaggagcagaggagagttcgtgtgactggagtcagagaattctagggcggagtaggaggatgagagtgaacagatcatcagaggcagatatctgtctttgtaaaccaagttaggaatttggatttttaaaaattgaggtataatttatatataataaaatgcaccctttaaaaatatacaattcagtggttttcaatatgttttcaaagtttgcaaagctgtgcagtctctattttcaggacatatcactctggaaggaaacctcatacccaggggaactgcgggtttccagtgtgagagtaagcccctggaagattgcagcaggagagatacgatctgattgatgtttttaaaagatcattcaggcagctgtggaaaatgagttctgggaagggtggaagcacggagaccaggtggtcttttgctatcctccaggcaagagatggtggcttggattatggcagtggtaatggtgactgggttcaggatctgtttttacaggtagacacgacttaattctaatgcagtggtttttttcagtgatctgagacaaaggatgagtttactaaatttctaacccatcatagattgaaactttggaaaattacataattataagtagagacagtgtttccaggggacatggctaaactctgttggtcaggagaggcatatgagatgcttttagtctacaccagtttttctgtcaacttcctggattgatctagagaactagctgataatacctaggaagggaaatagattgttcagaactttgagtaagcagctttttttttttttttttttttttttggaaaaacaaatacttttctaaaaggagattcaaagaactatttataaatggtgaaaaactgttagaactccagatgccgaagacctgctctttgcggacatttctgcttcccctagtcaggtctctcatttcttcctctgctcctacagaactgactgtgcctctgttgtgctgcttgagacagtgtctctactgactcatgtgcaggctgtttgtctgacctattagggtgggagtgtggaagacccttcatctcttacttatctctgcagactcctaacactccacatagtgctggcatgtattatcacataggagtgaagactacataaataatgagcacattaacatagtggaatactaggcagcttaaaaagtgacaggtatacattacatcttgtatataaaataatattaaaccaaaaatataatttcacaataatacaaatactgattactgcacataaatactatcatataaacgaaatatactaataaaaacttagctggggaacctttaacaccatttttatgtaaatatttctcaactttcagtagagtaaaaattaaaacacatttttaattgaaattaaatttgaggctgggcctggtggctcacttctgtaattccagcactgtgggaggctaaggcaggcagatcacttgaggtcaggagtttaagaacagcctggccaacatggtgaaaacctgtctctactaaaaatacaaaaattagccaggcatggtggtgggtgcctgtaagtaattccagctacttgggaggatgaggcaggaaaatcacttgaacctgggaggtggaggctgcagtgagctgagatcatgccactgcactccaggctgggcgacagtgagactctgtcttaaaaaaaaaaaagtgttgaatcagttttgtcctttaagtgttacaaagctgaaagccaaatgtcagcccagctcttcaaggcaatgcattttgtgtacttattcctgtctttagctcactttccttaattttcttattttaaatatatataggtataagtatatatttgacatggttgcaagacccccatttctcattctcagttctcctttatttttctccttaacatttcactctacctaacatactatagattttactcatctgttttgtatctttcttttctcactagaatgtaaactccataggaacaagaatgttcttctgttttgttcactgctgtttccctgcagtctagaataggactaggtatatagtattcaatacattgttgttaaattaatgaatcctaaataaatatatttgtctatttatgtgtatgtgttattttcttcaaactcaataattgactcaaaatatttgatccactgtgtaccaggcattggggtggagtggtgagcaaacaggcaaggtcccactccttaatggttctttcagcaacaaacatctaacatgtaccattataggtattggagacagaagggtagacaagggaggtaggctgtcacagaaaatggggatcaaggtagacctccttgaaggagtgatttatgagtaggagcctatcatgcgaggggagctagggatacagggaatgccatgttggaaagcctagtggtgaactaacaagtaggatacacacttcttgaacacttttttttttttttgagactgagtcttgctctgttgcccaggctggagtgcagtggcgttagctcactgcaacctccgcctcccaggttcaagcgattcttctgccttagcctcccgagtaactgggactacaggccaagccaccatgcctagctaatttttgtatttttaatagagacggggtttcaccatattggccaggctggtctcggactcctgacctcgtgatccgcttgccttggcctcccaaagtgctgggattacagttctgaaactccagggctcaagcagtcttactgctgctgcctcccaaatagctaggggtacaagcatgtgccactgtgtgcagtccttcttagacatatttatttagacaggaacttaagagaatcattcagtaattggctaaataggccaacatatgggtaaagagaataatagatatgattagatttattatccttaaaatcgtgggaaatagaatatgcttaactaattcttaccttgtctttgaattaagagatttttcttaaagcatttactctgctatatcagtatataactctcattaaacctttttctttttaaaaatacaggtttgttgaagaggaccatattccttacataaatgcttttcagcattttccagaacagatgaaattatatggacgtgacagaggaatctttggtatagaggtaagttattttcttttttactttctagtctctgataaggcacaagagtggtatgataatttctatttcttgcttgacttattatttggtgttttgtgttttatcccaatatggaacatcagtcataatttaacgaagagtagaattttattattttttattttccttatgtggattcctctaatcctttaggttatcctcaaaatatagctgtagtgtgatgtgtgtgcattgcagataggtatgttgttgagactaaacttgagaacttttatctagagacctttaggtaatttcaattttttaaaaataaaatatgtgttttgttgttgttatttgcacactatattgctatggaagaaagagaagaaagttattaccgtgtttctaaaggtactattttaagttcttcacttatgttagtttgtctttttctagatctgttttcagatgtctccaatggaagggtttctgtcctttgattatgagtttgtgtcactattggtggtactcaaaggttatttccccttggttctcatcagaagttttttttgatgtactaaatgttaaagattttcctccattcacctacttaaggaatcattttcatagaacttcatgaccctgacattgttggcggtgtaagagtcatttgttaagtgctgtttaatagtggcctgactttgatgaagggtaacctctattcagataccctttgatgttcaacttaatgttgaggtttatccctttccagcctgtcagtgttaataaatgcagacataaagtgaatttgcaaattttatggaagtttcagcatttcatgttatctttgaaattaatgtaggagaactgcttgcaaatccattgacaaacacagagctggcagagaatttaaagttgaagaagagaaaaccaataatgaggatggcacaataggtgcttccaaagggaaaatttgaatgtcaaaggattaagagtactccctggcaaagctgatagagcccctgaatattttgtaaaataattctctttgtagttatgctataatatcaaaggcaataggaaggatgtcatattgttgcgggatctttggggtgccgtttttctggctggaaaacctttgtggccggtggcatctttgcccaagttttgcactaggctcatttcgcccactccgcctggcaggctgtgcttggctcacgctaccggcctgggtctcatgcctgccaagggcaagtcaggcatggaatggtgatggatgtgtgagcaagcatggggtctggccagtcagatatgccacctgctgcagcggggcaggcagttccaggtgccagcatgattgccagcgatccgcgaggctgcgaccggaccagtcgcgctgcaagcagtttccgcagctggcattggggaacacggtggtacctgggagcttggagatgccaggaaccacagggcctcaaagagggagtcacagccctggctcgaggagctcccaggtctggactccccaaaggaccgcagctcttctttccttctctttgcccacaacatggcgagcaaggggcatgtttcagacctgtttgtgttacaactgttttagccttgccattctgtgcgtcctgagttcgtgtcctgcaaccaggaagaatgaggtacacagataagtggagggtgagcgagatgaagaggagctttattgagcgacagaacagctcagtctcccacagcgggcagctcctttctgcagccagggtatcctgatgagcgttcagctcctagcagaaaggagactctggaatgggaagctcctgtctgcaggcaggtcgtcctattgtctttgcagctctctcagcagagaggaggccctggagtaggttattcctctctgcatcccattgtcttcccagctctcagcagagagggggccctggagtgggttgcttctctctaaagctggtcatcccttctgagttggggtgggagctccctgggtgctgctgcagccacccaagccacagctgtggacgtgggcatccttgtgctctcaggacaacctgccctcagagaggagcttcccactctaaatcattcatagtgacccacattctaactcagtgcaaattctgccaatatttaataatctgagataaaatgttatggtatgttccatgcatattcaactgtatttctagttgtccatttccttctggctcagcgctccaaaattagtactttgtagaagtatagtgtaacaaattcttagtatatcttcgtagaacctatttaagtgttttggagaactaggatagtgagaagggcagaaaagtaggcaaacaggctaaaagatgatacagtgagtaaaaagcctaaatactgtagttctaagtcagattaccatctgtgtgaccttggcgaggcattctgtctgtctgaggtgtctgctttatatgtaaaattgggatatcagctgaactgtttatcatgcagaggtttagcagggatcacatgagatcacagatgtcaaagaactttgtaaactatacatgacacaaatagaaggtgacactggtacagaaagaataattgatcctccacatgaaaaactgtaaaggatattgcataaatgtagttaattcatggtttattttgaatgtgagtcattatgagtgatttgtagaagcattagatttttacagcaaaactggtttcacccttagaacaacttgagtgggagcaattccaatagatttggagagcagaaagcaagcttggacgtttggttccctcattctaggtgtgaatctttatgtcttcacagttattcagttttcctagagcgactagtggaactaagttactacttttgcattagctatcagctttgtcttggttaataacaatgtctttcttctgtatgtctcccttctttctccccacgcccccccccactttgtccttctctcccttaatctccagcaattctcagagctattcactactcaagttatattgataatttttgcttagttaaggttatttgtatattttcctagtgcctgaaatcatcatgttatctttaattcactaaccaaattataagctcctcaggaacagacatcagaatattttatgtagaatcatggattattaaagctggagggaaatttggaaatcatttagtccacttttcttatttttccaataaggaaacaaacctaagaagaaatatgacttgggaataagtaaacctattcttcattaggatttttcatgaggattatttgaggtagtatattcaaaatgcagacatattgacgtattcaaatggcaataggctcccttccagactggaaaaacttttcccgcaagatagggattaagagggtaatcaagctgtttggatcaaaaaaaaaaagacataccattttggaaaattaagtttccattttaagattctgttaacttttgaatgtgttcatttctagattttctcttgatctgcagtccagtgctctacttctgagctatactcgctccttcatttctaggttttctcaaattaggttcgaggaagtccatggatatgggaaaggataatgtatcttgtttctcatggtggtattttataatttcagttaccatgtattcaactttttgcaaaagatattgcttcctgtgctgagtttatatgcttggaaatggtatctaaccagtaatttcctttttaagaggtttagtttcattttaaatgtactcacatagacactcaaatttcactatttaaaagtaattattttcaaaaatttcttctatgtgttctttcaaatagtaatagatcccattattactaaatgtttaggggactgcaagagagagagagatataatacaccaaattaagagactgtttctataatagccattgtggcttacattgcccagaagcctagctcattccttcagttaagatttacattgccggccaggcgcagtggcttacgcctgtaatcccagcactttgggaggccgaggcaggcggatcgcgaggtcaggagattgagaccatccttgccaatatggtgaaaccctgtctctactaaaaatacaaaaattagctgagcgtggtggcgcacagctttagtcccagctactcgggaggctgaggcaggagaatcgcttgaacccaggaagcggaggttgcagtgagccgagattgtgccactgcactccagccaggcaacagagtgagactctgtctcaaaaaaaaaaagatttatattgcccacctatggggagtgtggtaagaagtacctacaactataatagtcgcatttatttctgacggcaattcacagtttcaacctgaaatattattttctcagtattgtatcacatctaaactgtttccttcctcttttaagttttaacaatttgagacaagttttgtaaattaagaggtgaaatgagttatgtttacttgctctttgatctgaaaccattcaaatactaatttttactcatcctatcaattactgagagaagagttttgaaatctccaactatgattgcaacttttgtttcacatcctatcagtttttgcttctgttactggagctctattactaggtgtgtaacatttacagtattttgtcttcttgataaattgactcctttatcattatctaatgtcacttttttctcctcgtgctgtttctacttgtctgatactaatatagccactccaagttttttttattgatgtttgcacagcatatctttttccaatcttttatttttgacctatctgtgtctttatatttaaagtgttttctggtagttagtatgtcattgggtgttgatttttaaacatctaattgataatctctgccttttaattcgtgtgtttaagccatttacatttgacataattatcagtatagttgggtttgaatctaccatcttgctattacatgtctcatctcttgttttttctttttttcttcttttcctgccttttggattaattaagaattttttgttgttgttgtttgttttatgttttttaaggcatagggtcttattctgtcacccagactggagtacagtggcatgatcgtagctcactgtaacctcaaactcctgggcttaagcaatccttttgcctcagcctccctagtagctaggactacaagcaaatacccccacagccaactaattaaaaaaaaattttttttagagacgtggtcttgcagtgatgcccaggcttaattaagaattttttaataatttcattttatctccactgttgatttattaactatacctctctgtgtttttttgtggttgctctagggtttacagtattcatctttaccttttctcattctacctcaactaataatataccattacttgtatagagtaagacccttacaacagagtatttccacttccctcctcccatcctttagtgtcaaacatttcacttctaccttaatgcattgggattttttttttctgtaagcaatcatttatcttttcaagagatttaaaatgagaaaaatcattttatatttacctatgtgtttgccatttctggtaatctttttatttagatcccaatttctgtctaaaaaacgtcctttaacatttcttgtagtacagttctgctggcagtgaattattgttgcttttcttgttctaaaaaaaagtcctaactttgccttaatttttgagagatattttcagtaggtatagaattctagtttcatacctttttttcagtactttaaagatgtcattccattgtcttcaggcctgcctaatttctgatgtcaatctgctataattcttatctttactgttctttatataatgtgccttttttcctttagctgctttttaagattttctctttatcactggatctcaccaattggattattatgtgccttgtcacagttttctttatgtttcttctgcttggttttttttttttttttttttttttttttttaagacaaatttttgctcttgtcgcccaggctggagtgcagtggcatgatcccggctcactgcaaccttcgcttcctgggttcaagcgattctcttgcctcagtctcctgagtatctgggattacagacatgcgccaccacacccggctaatttgtattgttagtagagatggggtttcaccatgtgggccaggctggtctcgaactcctgacctcaggtgatccacccgcctcggcctcccagagtgctgggattacgggtggggagccactgcacccagccttctgcttgggttttatttaccttagatttatgggtgtgcagttttcatcaaacttggacattttcatccattatttgtttaaatttttttggcctccccttgcctttttctgggatactaattacatgctagaccacttgatatggtaccatagctccctgaggcttttcctttttatttttctggcctttctgcttactatgttttgttttgataatttctattgttatgtcttcagattcagtgatctttacttgagtatcttctaatgtgtcattaaacccattcaatgtgtttttcatttcagatactacatttttcatttctggaacttgcattttagtcttatttcttctctttctcttctcattatgttcttgttttcttttatattcttggctatattgacagtatttgtaatagatgttttaaaacccttgtctgccaattccattgtctttgttatttctgggtctgttttattgattggttatgtatcatattttcctgcctctttgcatgactggtaatttttttttattagatgcaatcattgtaatttttatgttgtagagtgctagattttttgttctagtgtataattaagtaacttgaagaacagtttaatcctttagaagcttgtttttaagttttgttgtgtgtggtttgttattaatagtccctttttttctgggactattttagcctcactactaaggcgtatccctactaaagactctacccaatgcctctggtattacgaagtctctgcactttggctgtttgccttccgtgagctttggaaattgtttgctctactgctttcctgttatttttttccctggcctcagatattttctcatacatgcacatattgatactcagcaaaacacatgagagggcccctttgcaggtctctggatctctctgtctatgcaattttgtcctttgtggtactaagcttgcaaattttagccacctcagcttccagaaactccagtccctgtctcctctgctcatcaagaccactgagctctgtttcacttcccacccttgcactgcactgcagtttggaaactgcctccaggcagtaagctgggccatttgtttctcttctctaagggattagtgtccatgctgtctgttgtccaatgcttgaacctgttctttcatatattttttccagttctctgttggatacggtggaagctcagttcccatggttggtaatccttcatgggcagaaacagaagtgttccaaatactaatttttagacatttagaaatagagtcagtattcagatgctttttaggtattacctgaacagttctttctcagatgcctgaaagcatgttgttgctcactcattcttggatttttttaaaaaaaaattgtagtctctgttcatgaatattgtcactaatctgatctttacttaaatcttttcccctaaatacctgccctagtaataatcccttttgttgatctattttttttcttttttgaagtaatattgtttttaattgacaaattataattaatacatgtatggggtacagtgatattttgagatatgtttaccatgtgaaatgattacatcaagctaattaacatgtctgtcacctcacctatcatttttatggtgagacatttgaaatttactctcttattttattttttttggggacggagtttccctcttgttgcccaggctggagtgcaattgcacaatctatgctcaccacaacctccacctcccaggttcaagcgattctcctgcctcagcctcccaagtagctgggattacaggcatgcgccaccaatcctggctacttttttgtatttttagtagagatggggtttctccatgttggtcaggctggtctcgaactcccgacctcaggtgatccacccgcctcagcctccccaagtgctgggattacaggcatgagctactgcacctggcctactctcttactttaaattatacaatacagtcatgtgctgtataactgtttcagtcaacaatggatcacatatacaacggtggtctaataagattgtaatggagctgaaaaattcctgtcacctagtgatgttgtagacttcataacttcttagcacaacacattacttgtgtgtttgtggtgatgcttctataaacagacctttactgccagtggtagaaaagtataccatatataattatgtgtgatacagaatacttttttaaaattactgtcctgtttcttttattctccacctttatttccctgtaaggtgtaagaatttttttggtatgcttaatttttttaactgatgcctgatacatgtacctatttctgggatacatgtgataatttaatacatttatataatttggagtacataatacttgataataactgttactgttactggtttatgtatttactatacttgtaatcattactttaaagtgtacttcttctacttattaaaaaaaagttaacagcctcaggcaggttccgtaggagatattccagaagaaggcattgttaccacagaagatgacagctccatgcatgttattgcccctaaccccatataggcctgggctaaatgtgtatgtttgtgttttagtttttaacaaaaaagtttaaagagtaaaaaaacaaaaaataaaaattttaaaaatagaaaaaaacattatggaataaggatataaagaaaacatttttgtatagctgtacagtatgtgttttaaactaagttgtattacaggagtcaaaaagttaaaattatttttaagtttatatagaaaagatgcagtaagctaaggttaatttattactgaagaaagcatattttttataaattttgtgtagcctaagtgtacagcatttatgtagtgtgcagtaatattgtaagccttcacattcactcaccactcactcactggctcacccagagcaactttcagtcttgaaggcttcattcatggtaagtgccctatagaggtgtacagtttgtttatactgtatttttactgtaccttttctatgtgtagatacataaatacttgccattgtgttacagttgcctacagcattcagcagtatataacatgcaatacatgtttgtaacctgggagtagtaggctatctcatatagcctaggtgtgtactgggctgtaacatctaggtttgtgtaagtacactcttcacacaatgaaattacccaatgatgcatttctcagaaagtatctctgtcattcagctacgcatgactatacattattattgactgtagtcactctgctgtgcggtagatctcaaaacttgttccttctgtcttctgaaactttgtaccctttgaccaacaactccgcattccctccctcctcagcttcacccagccttagattcttcatataagtgagatcatgcagtatttgtctttctgtgcctggcttattttacttatgggccctctaggttcacccatggtgtcgcaaatgacagaatttccctctgaatttaaggctgaatagtttcccattctatatcagtacacgttttcttacattcatccatcgatggacacttaggttgagtccatatcttggcttttgtgagttatgctgcagtgaaccccatcaacatattgattttgattttttttggatattatccagcagtaggattgctgggtcatatggtagttctgttttaagttttttgagtaacctccatttcatttccatgatggctatagtaatttacattcccaccaccaatgtacaagagttcccttttctttgcatccttgccaacacttacctttcatctttttaaattaattttgagtgaagggacagggtaaaaaagcagagagacttcttagagattttggtggaagatataagcatagaaaataatatgaaattacatcttggtagcaaccactgcactttgctttttttcacttacatcttggagagcacttaaaaaaattattttggaataattttagatttatagaaaagttgcaaaactaagagtagtacaaagaatgcccatatatcctgtatccagagttaactgttgttagcattttatgccattgtttgatcatttgtgccatttttcctatctgtctacctacctacttgtgtatctgtgtaattttatttctgcgtcattgattataagttatatccatcctgacccattactcctgagtactttaaaagactaaaacaaggtagctaggtaatgaaaaaataagccaaacaaaaccagaaacaatctaaatgtctatcaacaggaaaatggaaaaaatgtgatatagtcatataatggtacagtaaaccactatgaaaattcatgaactgcagctgcaagcaacgtgaatgaacctaagaaacattatatagagtgtgaaaggcaaagctcaggctagacgtggtggctcgccctgtagtctcagctactagggaggctgaagtgggaagattgcttgagccttgggaggtcgaggctgcagtgagctatgctcatgccactgcactccagcctggacgacagagcaagaccctgtctcaaataataatcataactttaaaaaaaaggcaaagctcagaaaactacatactatggtataatactgtctttttaaaaggcaagttaacaatgagcaaaattcagtaaactagttacctctggaggcagagacagagggatgggatagggaggaagtatactagtagatacaaccatattggcaatgttttagttcttaagttgggtagtggattcataggcatttattattaccaggcttcatagcttacagatatagtatatgtattcttttgcatttttcagaattttaaaggcagctaaaggatgttgtctaaatagaatttataaaagagaggagtagaagacagtatgtcatgcatgatttgtttgtatatgtcttacatccttaactaaaagtgtaaattgagcataaagaccgtatttaatgcttctattttattatctatattatagattctataagacctactataattccgtctacaaaataaggactcagtctgtgtttattgattacatgatttgaaatagctataaaacagtaagtttaaacactattttcagaaaaattcaaattgatctgttggggagtttttctcacataggtaggaaatttctagactgcttctgatatatttattatacaatatatcagaaggccactaaatagtggcatttggttaagagaaatttaaagaaaaaacattctattaaattttagtggtaaatatataaaggatataacttctgcttgttagcaaggacatttaaaaataagagttatgggtgtgtcagtatcattcatatgaaaaagttagcagttcatattcttaccagtatgctgaaaccaacagtgaattactcaggctagaaaatgtatctgaggctacatttatatttcttttagaatcatacctcatgtttgctaagtgaagctgataattttgtgtggattacctgtgattttgtttcatcctgggccagtatgccccagtacccagtatacctggggcttccctcacctgtccctcccaggaggagagaatgggaacctggtgttacactagcctaaactaaaccgagtaacggcagaggtaaatctgctgcaagagtaatcacatgacccttccaaaatcaaatagaaattattttgagattatctagtcttctcgataccatcttttaaacttcattaccacagatatgtgaaattggaacatggctatgcaacaatcagcagagcgtttggagaacaggcacatattaaggaggactccaataggtttttaccagctctgatcctggggccaaaacaaattattatctcctgttcagttggcaaatcctcattggtcagcagttcataattttgtatttgttcataaggtttgtgtttgtctgtacaagttgacaacgcgtttctaaaaaggcctcatcctcagggccaagactatatttcacataaagcaatgtgttcaccacaaactcccagaagactagattttgaacacaaaaaaaattttttgtggttaggcatggtggcttacgcctgtaatcccagcactttgggaagctgaggcgggagtatcccttaagccccagagtttgagaccagcctgggcaacatggtgaaactctggctctacaaaaaaacacaaaaattagccgggcgtggcggcacctgcctgtggtcccagctactcaggaggctgaggtgggaggatcacctgagcccagaaagtggaagccgcagtgagctgtgattgtgccactgcactacagcctgggcgacagagtgagaccctgtctcaaaagaaaaaaaaaaagtattttttctactacatggtaggtttactgtcattaagaaaagtctagcagattaaaaatgcaaggtgaactatttatgcatcatgatacatgtggaattcattttattctttttccataaataattacagtgctttgtcattacttctgatagttttattccttgttaattctcctttgttatggagagtcttgataacagtttggtttaacaggtgcactttgcattagctttttctcagttgaatctgcctcaaaacaacaataagaataagtaagggtgaggcactgcactctttttttttttttttttttttttaaatagctgagcaggaagtttgcctctgacagggtattgtaatcaggtttatcacaggagcctgctgttgtgtaacagaaactctagcctgtccttacctgtcttaaagtattgcttcacgaaggaaagtaaactcgctgtaatatttgtgaaattcaataaaatgctttcccaagcactccgtttttaatgcatgctggaacaatttattgtagctttgtggtcttttaaaaaacatgttaaacttgtgatttcttactattgtaatgaaatggacctgtatcactcgagaagccctgtatgtcacatttattattccttttagacacatcctcagccaagtgtagtaaatgtccacactccctccctgcttccctcccttccttccctcttttttcaagaagaggaggtttgtgttgccttcagatgactgttgatttaattgacaggcagcttttcttcattgtgtgctttttgctattgctcacaaaagtgcattcactattctatagtatgttgaaacttttaaatggaaacggcttttcattaacaaaggaagcattttcttccccccttccatgccttagctttctccgctaagtcttggcttcttcagcagctgtacctccaccagaaatgacaaaaggtgcaattgtgctaggagatggcgatgaagatatgccagtggagttttgtgtgtgggctgctggggactgttttccttctgtgtttggttttgttttatttttgttattccagaaagttgagagcacatctaaaaaccaaaaaaaaaaaaaaaaaaaaaagctttaaaaacccttttcaaacctttatcccagctgagctttctttccattaagttgttctgttagtatttcagtggcccctctgtcttaataacaacaaatctggcaaaactcacttaaagcagagggacatggaatacagagagtgttgatgtggtttttctttttctaagcaggccatgagagtctgagtcttcctgccattatcctgacttaagagcagagcagagctcaggagaggagataggtgtgcaaattaaattttagtctttccagccatctcctttttctgagttgtgattcctgagcccaagtagatagccagttcatttcatttacttaaattaatttggagataaccctcttctcctttttctgcctctgcctcttctgctgcttcatttgtgactcaactttctggagtatggtgctgacttgaagccctatttacttctagcaaaaatctttcagtttacctggtagaataaactgaaaatctagtacctttcaggggcaccatctcttcacagcataccaaataatcagatcactgattgaaccaaagtattgggtctagatatacttgtctgtattagatacaatttattctgtcagtgacttaaaatagggctacttctatcttttcagccttgattttcttgatatattttaaacctacagatcagtttaaaaatagataatatgtaacatagatactattctaccacagtccttggcagtgtttctcagtcctctcaagaattagtcatttcatcatccctcactagacgcagcaagaagggataaagaggaaactggaaatttgttctgaagtacatctccaatattttgaatgttgatcaacagcattctgatcttctccctgaatgagtaaaaagaaaagatgtaatactgggtcagccaaacccactgcgtggcacttagccaggatgattcattttgcttggagcaatcttacaccctttgtgaaactgggtttcttttggttgaaggaagaaaaagactcgtccagagctgtcagtcacttcttaagcaccttcaaatgagggccttattggattgttttgatctgcccagaatcttcaaacctgactctagatttgttcaccttcttactctgtaggccacatgtaatgcttgggattttttgtacaatctttattagaataataacctgacaggtttcaaatctacttgagggaagttgaagtgaacataatgatcaggttccctcatttctactcttccctcccagacagcatgagggagagaagccagctggtgttttcttgtgttcctggcccacttcccccaaccccccaccccgcccccagctaccatcatctcagcctcactggaatgtgtatgtgtgcttctctttccaaacttggagagtaaaactatctgagcacttcctcctgtctacaagaaaagtagcctctgcattttattttttgtttcctacaaccggcatattctgttttctggggatccatagcaatttcattaatctctagaggctctcaggctttagtatgcataagaatatcctggagagcttgtttaaactgcagattcttagacccagtgtcagaaattgattcagttaagtatagtgtgggctctaagaagatgtttttcgtaagcatcttgcaagtgattctgatggagattacgctttgagcagtgcattatataagccttatctctatgtctgtcttttgttattccaccttgttccacagaagatttgaggtagaattagcagataaccaaagggtcagtataaaacaaaatgctgttataccttattaagtatgtgttgttttaaacaggattctgtttaaaactgtttgggaactatatctattgagaaactggtctgtgagtttaacatatatgaaaacagtgaaaatcaaggctgaaaagatagaagtatccttcctctctctgtaagtcattgacagagtacagtgtatctaatggagaagattctggcaggcttcttattctgggaaatgtagacacatatcttggtgttacatttttaataattatagtttaataactccgtatttcccccaaaagtgtatttataagaggtttcgtgtaagataaaagtagatattagcaagtggtatagattttgaatgtctgtagatttcatatatgctgaattttttaaatttccagctttattacacttctaattatgacctctttaacatgtgttttttttttcctttagacagacattacttacattccttttttctttttttttttctcctgccaccttgtctgagaacttaggttccattttatactttttttggtggcaaaatatacataaaagttaccattttagccatttgtaagtgtgcagctcagtggtattaagtgtatttatatttttgtgcatccatcaccaccatccatctctagaattttttcatcttcccacgttgaaactcatacccattaaacaccaacttcccattccccacttgttccagcctctggtaaacaccattctactttctgtctctaggaatttgacttctttaggtatctcatacgtgtggaatcatacaacatttgactttttgtgtctggcgtctggcttacttcacttagcataatatctttaaggatcacctatattgtagttcgtgtcagaatttcattccttttcaggctggataatattctatgatatatataaaacattcaaaatctatatatactacttgctaatatccagctttgtcttatataaaatatatatacatttacatacatacataccacattttgttcatccattcattggtgtacatttgggtcgtttctaccttttggctattgtgagcagtgccagtaggaacattggtatacaaatatttgttcgcatccctgctttcagttccagaagtgcaattagtggatcatatagtaagtctatatttaattttttagacaaccacaatatatttttgaatgtttttttcttattacaaaagtaatgtattcagaattagaaggaatgtagaaaataatgagaagtacaaagaaggagatgaaaatcacagtctgatttctcatgaatgccattaacatttgctatttttgattgtcttgtttaatgtgcataaacatatttgcaaaattaggattgaagcatgtatacaaatttgtctcctgcattttaaaaattgagcattgtactatgaatattttcctaaatcataaaacagcctatcaaagcacgttttcttagctgcttaatatgatgcatgatatgtgtatctaacataaatatccagtaataaggaaatgatggattcataaagaagaatgttttccagtcactcaaaataatgttctcacaggctatctcgtggcattagaaaattctcacaaaacataatgttaggtcaaaattcaggagatgaaactatattcctaatccagtttgtacaaaagctctcagacaggcaggagcttagcctaagagcagtgtaaactattagagggattttagtaggggaatgacataccagattttcattttgtaatcttaccctgggctgcatgcagtggctcatgcctgcaatcccaacactttgggaggccaaggcaggcaaattgcatgaccctaggagttcaagaccagcctgggcaatatgacaaaactccatctctacaaaaaatacaaaaaattagctgggtgtggtggtgcatgcctatagtctcagcctacccagaaggctgaggcaggaggatcacttgagcccaggaggtcaaggctgtagtgagctgtgatcatgccacagcactccagcctgggcaatagagtgagaccctgtctcaaaaataataataataataaaataaaatcttaccctggctcccagttgcaaagagctagaagcagatatagggctgtcaggaggtttttgatagttcgggtctggggtagagttgttaaagtgatgagaaagactatcactgaagaccaggcttggaggtggagtaaacagtctgtggaatggaatgaatgtggtgtgtgagaaaagggaggtgtcaaggatgttcctaaatgtttgctttttgcgacagggtaaggaacactgctggagggattaaaatttagggatgtggaagatgttgggatatagaagtttgacatactagaaagataatccaagtagagatgtcaaataggctgttgaatttaaatcccaatgttataaatatggatgtgcccaaatgagctgagagaaaagtccacccagatcctaacagagggtttctctaagttgtcagagatttttattatcttttagtatagaattttatatttcctaaattttctataatgttgatgtgttatttttataatcaaatttaaatgttgctaacatatattcatcatagcattctttatactggtttaaaaatgggaaacaacctaaatgcataacaatgaggcaagactggttaaaagaaaatgggataggattgaaaacctttagccacctttaaaaaaatattttgagtgttactcaaaaaggaaaagttggttcagtttaaaaataaaagaaattttaaaaaatgaaatctgtaatactgaattgagactagcagaatctggaatctaatctataggatagataggtagatatgcacacttaataattattttctcctcaattcatattcgaaagaatagtggcctctttgtcaccagatgttgactttcatgtatcagcttttagtgtggaagttttgaaaagatgctaaatccttgtagcctaccaaattgcttctcattagtgaccttacacatacttgtcatgaatttatcatccattaaatcattttttagatgattttttttctaaggggaacatttactgctctagtgttttgtttgcagataaaagtacttaattgcatctcttacctgcattatttaaaaggattaagattgctgtaaatcttattagtaatgttaaattgtctcagcttgaaaagatgcttcaaattctgtgcagaatgaaccagaggtctaaattaattaattttacaaataaaaaggaagacaccttcttttcaaagttcactgagaacttatgtttttcttttctctctttaaaattcacagattaaaatacaattaatagtattttagtgtacaagtagaataactgtatcccaacattaaaaaaaaaacttaaaatgccacattgctactttggattaagagaaaattactttgtattcttcagctacagatcaatcatatgttgataatataacataaactgaaggcatttttcctaaggaaatgtaagagtttagctattgaaatagttgtaccaaaataaatataatacagggaagattttagcttcaggcaaagtaaaatcaagcatagttataaattctaaaaattaacagtgtaattgtctccgttaagcatatacccctgtaccattaaggtctttccacctttgtatttgagcaatgatttctcccacaaaggtgatatatgaagcttttttttttttttttactttttattgaggtaaaatagacacgtaggaaagtctacacatcataaatgtatagacagtgtgatgaattttcataacctgaacacagccacagcacccagcttcatggagaagcgttaccagcaccccaggagctctgctgggtgctcccttccagtcatgtcctacccacccttagagtaatcaaatcctgacttctaacagtacagaagatggggacagagttactgagttttatactttatataactggaatcattctcttttgcatctggcttttttctttgaacattatgttttgaagattgattcattgttacatgtagcacattcacttactgaacactgttctattgtgagattatatcacaattcacttatctattctagatacgtaatttatggacatttgagtaatttccagcttagagttttcacaaatagtgttgttatgaacatcctagtacatgtcttttatgggcatgcatacgcatttctgctgagtatacatagctaggagtagaattcccttgacctaggaggtacatatgctcaactttaatagatactgcaaaatggattttcaaaatttttgtattaggctcaattttgatactgttctaccatatcagaaatgttggttttctgaaatcctacatgcacatgtgtgttgtactatagttatttatccaagccttctatctcctttctcgattgtcaactgcttaaggagattgtcttattcatctttttatttctgagattatcttattcatgtttttatttctcaaagtactttgcacaattccttgcatagaataggctctaaactaaattttattttattttattttatttgagacggagtctggctctgtcgcccaggctggagtgcagtggcgcagtctcggctcactgtaagctccgcctcctgggttcacgccattctcctgcctcagcctcccaagtagctgggactacaggcgcccgccaccatgcccggttaattttttgtatttttagtagagagggggtttcaccgtgttagccaggatggtctcaatctcctgacctcatgatccgcccggctcggcctcccaaagtgctgggattacaggtgtgggccaccgtaccctggccactctaaactaaattttttatgtgaatagatgagtaagtgaaaaactacatgcagtattaatattaggaatgtttataaattgcaaaaatacaaatggtatatgcaaaaaacttcgagttcttaaagtaagtgctagacagaatatattaatatttgttcatagcttttctgaactttgtaagagaatcttatatatttttatatgtgcgagtttagtataaagttgaattgtggatttttaactactagacttaaaacctggtgttactcccatgtggaaagcacgtgaatattatgtaacagtgagccgcatttgttagctatgaatttgaagagtaatgagagagtgcaggtgggaaaggtgagagggaggttgtgtatcagagcagtcatgacaacattataactctgattgggttgtagctttcatcctttctccagattcttctaaggcaagaagtagtgattttaccatatcatgggaaaacccagtaagagttttaagagccaaatagaattttagtggcttttaacatttagtatttatgacttaaaattgctgagttaaaatattaaggatttatgggggttttctcccttcatgcttttctccaaattccaaattttattcagtaagtgcatattagttttatctgttcctttttcttttcttaagcattccaaatactttggcttggaacatattacttgctaaatcagaaattttttttttctttccaactttgattttaggttcaaggggcacatgggcaggtttgttacatgggtaaattgagtgtggtgggggtttggtgtacagattatcttgtcacccaggtaacaagcacagtaaaggtagttttttgatcctcaccctccaccctcaagtaggcccttgtgtctgttgttcccttctttgtgtgcctgtgtactcaatgtttagctcccacttataagtgagaaatgcagtatttggatttttgttactgcattaatttgcttaagataatggcctccagctccatccctgtcactgcaaaggacatgatcttgttcttagggctgtgtaatattccatggtgtatatagacgacaatttcttcatctagtccactgttggtaggcatttaggttgattccatgtctttgctgttgtaaatagtgctgtgatgaatacacacgtgcatgtgtcaatgacatattcctttgggtatatatccagtaataggtttgctggcttgaatggcagctctgttttaagttctttgagaaatctccaaactgctttctacagtgactgaactaatttacgttcctgccagcagtgcataagtgttcctttttctgcacaacttcaccagcatctgttatttttttactttttaataatagccattctaaatcagaacatatttttaaaaataagttttgttgcaaaaattgcaactatgatggtctctcttttatttcagtcttggcctgactacgaggacatctacaaaaaaacagtagaagttggaacatttttagatttgcctcgttttccagacataactgaagactgctatcttcatcccaacatactgtgtatgaaatacttgatggaagtcaacctccctggtaagtgtgtgacatatattgtggggacactttaactagtagagtaataataagcagagtatagaatcttttcaaatcacagactattagaaccacctgaaaaggtccatggttacatgaaacttaatgtcaaaatcctttcttaaaataattcagaccttttaaaatcattaaagggacaatattcagaaatagagttttcagaaataagagttctgttttggtgtgagggatttatgcttgagagaatatgtttgatttttatggtaagtttgctaagtgcaagtaaagtaccaaatgtttcagtatatgtttttaatgacctgtcctccatcccaaaacggcactttttaatttgcatgaggcattattattacataatgaattctaatttttaaaaaaatcctagaagctaatctgtggtaacatttttgttgcttggtaatatatccagtccataaaacaaatggagatcaaagtctggtcagatcatattgaactctttaaggcagtgaaacatagaatgtaaaaagagcctcactatacctggttcatagtataccaacacacaggtaacctcagtggaatctgctggtggaatccagtcctgaatttcttgttagactagaaatgtgagaaattttggacttatattcttaagagaaaatacaaacgtggtgtgactataccattgctgaagcatgtaaaaaatgtgattgaatgtattgttaataggagagtaaaatacatgtgttatgtgaaaaaagcaatatatgaaattgtatgtatagtaactataaatgtgactataaatatgtagtaacatatataaatgtaagtattgtcataatttaaaaatattttttaaaacaggaacaaaaataatttaaatttttcaaatgtaacatttctaaagctaaggaatatggctcttattgagattccagaaatcagtaattatttaagattccagaatttggaagatcttatttctgcatttggacatgttgtatagatcagaattactattttggattttttttttctttctgcttctttgatgggtctctcaagtgtggaaagttcctgtatgctgtcttatgttctaaatcctgagtttatagagagaatactgggttatggaaggaataccagggattatcaaaatataactgatgcagcctggttaatagcaagcaagcatctatgtcacgtgtttattattggacagagaggggatgataggttttctggctgttatctatagtttaaccatatttcttgcctaacatttcctgtgcgtaaggagtagaaataaatccgttacaatatacagagagacattattgtcatttgatatttattaagtgactttttggaggcagtattataaaaaatggaggtagaaaaatttcacttctcacagtctgttcaatagaaataatttgaaatatagaaaaaaattacccataaatgtcattagtctctttatttataatattgaaaaatcagaaacaaatatccaaaagaaagggaagggttatgtaaacagtgttgtgtacgttcagtggaactttaggtatgtagcttttaaaataatgtttatgaagagttcataaaagcatggaaaatgtttatgttataataaaaagtcgaacaagccaaattacaaaattatgtataacgtaaccacagctacagaaaatgaagacattcatgaaaatattagaagtaaatataccaaaatgttaaagtggctatttctaccttagggtaacacatgttatttttttcttctcctacctttatgtatcttataaatatcctatattgagttgtattacttattaatgggcacggggagtgcaataagcttttgcgattttttgaagataagatcttgctctgttgaccaggctgaagtgcagtggcgtgattgtagcttattacaaccttgaactcctgggctccagtgatcctcccacctcagcctcccgagtagctgagactgcaggcacgcaccaccatacctggctagttttttttattgttattatttttaatagagatgaggtcttgccatgttctccaggctggtcttgaacctccaggctcaagccatcttcctgccttgacttcccgaagtgctgggattacaggcataagccaccaagcctggcctgtttttttttttttttaacaaaaaatagatctacaaattaagttacgatagtccctataccttaggatgtagattctaaaatgtttacagttggtttgcaaaccacccatacataagattacaagagtatttccagaatgtgccatttgtaattacaaatattgctctcggtaatgccgtcagttgtgcagtgccattgatcaaaaagaagagatctatgtatgtggcacttttacaaagagagggtttagggttcccagaaagctaaaagcggttttaaacatgctgagacaatagccgcccctcctcaacgcctttaaaggtgaccaggtagcctctggggctcggggaaagctttcggcaagtatgtcacacacaccctgcctgagtaagcgctgcccctttgatggccatgaatgagctcagatgcactctccaccctctactatggttcctcccattgtcacccacgagcctgctggatagagtttctgatggctttcatgatcatttatgtaatttctgtttcatgtatgtaatttctgaagtttccaaagtgcccatatataaattctcttctttgtgaaggtgggaagggagggcaagcaggcttccccttgacagatgagacttagggcagttcagggacactcagctggtagatggcagagtagattcctacaacccagtcttccccttccagggcctgtgctcttcccaccctctgctcccttccaagaccctatactgttcttgctaccattctcatcatttcttccagttgcttttcttattagtctgtacttttggcataagcggagcagttcaagatcttaattctttttttttttttttttttttttttttttttttttgagacaaagtctcactctgtcacccaggctggagtgtaatggcgtgatctccgctcactgcaagctccacctcccacgttcacaccattctcctgcctcagcctccagtgtagctgggactacaggcgcccgccaccacgcctggctaattttttgtatctttagtagagatggggtttcactgtgttagccaggatggtctggatctcctgacctcaggtgatctgcccaccttggcctcccaaactgctgggattacaggcgtgagccaccacgcctggccaagatattaattttaaaagaagagaaatatttcaagaaatgtcatttttttagaataataatactaatatggttttgatttttaaattatctgagaagagactgtagcttctacaacccaatatagataatggttaaaattttagtgaaggtattttaaaattaattttttccatgtttgaagtgtacatgtttgagtgcaagagtcctatcattcatttctctaatttcctccattatattaatgcacagtatcttgtacctagtagacactcagtaaatgcttgttgaattgagcttaattctctatctcctaatctttttgcatctgaatgaagcccaggagtaaattcaggtgacacctgtaaattgaaattatcttaatagtataatagtccaaattctctgcctcacaaagacctgcactgtctggctctgccagcctcttcacattcaacactaaagccttgttggactgtttgcatttcctgaaagcaccatcccatgtttgtcatagcctgtagcatactgcattctcattaggaaaaggacttgaggaagaggactgtgtctgtgtcttaagtacccagaacacactagttgctcaataaatgtttgttggaagaataaaagccaagtgaaaacctgagccaagctaccagaatctggtagacagaaaaatactttgatgcgatattttgaattatcattgttatatgtgttctgtttctatgttaacaaagcattttttaatcagcaaaacttttttacttaaatgtttcaagaaagaaattaattttgtgttttattctttatcataaacgtgtaattagtacgaattatgtgtgggttgtagcagttaggaagacaaataaaacaagattgagtcaccctcaagtttaagagggaaacagaaagataaacccttaactgtgcaatagaagggtacatgccaggacatctgctttagcactcagaagagggccagtcacaggaggctgtggtatcatgtctgttcttagaggaggtcactggtataaccaagttctctaagatgagtgagcttcagccaggcagagcctgagatgaggaatgggggaaagaaactggctttctaggcaaaggggcaaaagtagctgtgcaaagcagagaggcaagtgagaatatggcttgtttgggggaactatggagattaggctgggagctaaaagctttagtgagttcatgagagcaggggaatacgatgattgggccacaggagagtaagactagagaaagggagagcagttataagggtggcctaaggagcaacagtgacgggaagaaaggggatggattggaaagcagtcagcactgatccaagtgccttaggtatattcattaatttagtcttcacaacagctatgaagcaggtactattcttattcctattttagatagattgtttaaaaactgaggcacagaaaggttgtataacatgtccacggtcacagagctagtaagtgatggagcagggactctagtccaggcagtttggttccatagtctattctcaaccatggtactatatgccacattgagagaatggaattaacaggacatggtgactgaatgcatgtagaagattcagttcagttccatgcaagctcattatctcttataaaaaatggctgtcatacttgaaattgtgtggtcacagcttacatacttagattgggaagtacagaaattttttgtttagttttcaaagtctattcacttgaacataacctcaatttattctcattataacccattttacaagtgaagaaactgaggctaagtgactctgatccaagagtcacaaagctagtgattggaaagcttaaatataggtcctaggttttctggttccaagtcccacattattcagtcttgagtaataggtgtagtctatgctgaacatataatttctttaggaaagcaatatatctagttaaacagttgttgagggcttccagtgtgctagccaggatgccagccagtgcacatacattgctagagaagcttttggtctcataagggagttagttttaggtgagcaaacactgctatagaaacacagacaagagatgtggatgaaacaactggtatgtggctgccagatgccaggatgtgtcctagaaatagtagatgttttaggaagtcggaatagggaatgatacgccgttttaagattctaccattcatttttctatatggatgccatgttttgatgttttattcacaaaatgtgggtctctgagttcttgcatagtgtcgtgttttaagataaaggttattttatggatatatacattggggatggtctagttggcaaataatttacattttactgttttgttcttcagatgaaatgcatagcttaacttgccacgtggtaaaaatgactggaatgggagaagtggattttctgacatttgatcctatagctaaaatggcaaaaactgttaagtacgatgtacaagctgtagctatcattgtggtggtattgaaactgctctttctattggatgacagtttcgagtggtaagtgtacgtcaattttatgacaagtaacattttatggtgctgatcttagttttttaagaaagctttaaatgtcatgaagacactttaaaaaaagagctaaagaaaaaatttgtactgtatttacctaattatatgttatctcaaaaaatggagactctcaattgttacagaacattgactagtagtcacaattatttcttacacagtactttgactcagctggttgtcagttgtttgatcatgttttatacctgttattctttaggtagcaatgttcctcattgctccactgatttcctagttttaaagtatcttcataaatctctatctatatccctttaggctcctggcaatatgtgttctcaaagattattttagaaagtaaaggaatcttaatatgtcacccctcccagatgccaacaaagagtgacagtatttatagtgtctcctcctctgtttcagtgattgcttctccattaaaacatggtatcaatttcaaatactgttctacacttttctctcagaagaattcagaatttatctttccaaatacatgacttctaaataaattgatttgtttattgttatctccaggtctttgtctaatcttgctgaaaagcataatgaaaagaacaaaaaaggtattttaattttttatcattcaaattcaaagtggttatagatgatagattaaaagatggaataaatgtaggcaaacaactttgaaaaatacacatatacacataaacacatgtatacaaattgtatattgtaccagtattgttttttcatataattacctacttgtatctctagggtactaaaaaatatcagtgagtccgtattatatgtaagaccaggctgctttgtattcccaacttctactcaccagccatgctagatcatgaatttacaggcagctttgtgaccatcctgtcgattctgatgctttcagcctttgctcttgttggtccctctatctgaaatgctctttccttcttaccccaactcctgttcagtccctggcaaatgcctctttattcttgaagatgcagcataaacaccactcttctgtctggtcttcacacctatccacttcacaatgcttcacctcttcccaaatcagaactaataactcctgccgcagtcactcttgttcagacttttgctagatgtttagtgccttgaggtctaactaatggcctaagtacgtctgtccctattagattgccaatatttgtaaagtgcttagaagagtatctggcatctaataagtactttataagtgatagacagatagacaagtgaagtgtgagcttctggagggagggatcatatctttttttttttttcttttaatgtatctttagtgcctaacatagtgactagcctaagagcaactcagtgaagtgtggtgaatatgtggattattaaattcaattccagtttcttaatgttctgttctcattaggatttatgttcattggttttagaggcttgaatttattggaagcaatcagtttgtgtgttctttccagaatatgtgcaaaataaaatactactttctgtacattgctcatgttggcttctatgtagagtgaaaggttgaactagctgtcttctaacatcccctctaatgctaaaagatgataatttactacgtagacatgtagaataaacagagcgctttgacctgtctccctgtaagcctcaaaataaatccatgctgtcagcagggcaaagatcactgtcatttctctctgctctgtctgctaatcaccatcccctgcccccagcattattgatggggagattgaggtttagaaaagttgtgatttactccaggtccaagaaccgtgagttctattgattactatagttttcctctgttcttacagttctttcggtagtttcctctcttctgtggctgtatggtctacaaggtcatattggattaaacaattatcatattgaccagttgaaaagatttttagttaggcatggaaagagactgccttcgccagagaataatggagaataatccctgtatggagtgaaagagtgaggagtgagtttttatactttactgcattcagttctgttgtctctctaatgtctacatcttgatcacacactcacaccaactgcccagtgcagtcaattaatgaaaactcagatgaacaatgtatattattatagtgtggtttatttggttaataatcttggattttatttctttcagataagccatggtttgatttcagaaagtggtaccaaattatgaagaaagcttttgatgagaaaaaacaaaaatgggaagaagcaagggccaagtatgttctccttcctggtttagatgcacctgccttacttctgtgtctgttactttacatttgaaagctgaagcttcatcagtatacacttatctacattgtgacttttttttctggaaatattagccctacactctaattaacttttctcttttttacattactattaatcaaagtttagatttgatgtggatttcaccagtgtttttattaatgtcctctttctgttccatgatccaatgcaggataccacagtatactttttataatttaactttttataatttgcatgagacttgcctatatttctaatactcctccctcttcccctttctcaaatttagtcatttctcatctatgcttcccaatattaaaaagattacaaatgttaccttgcaacatatgtaattggaatgttcccccaaaataaagatccctgtgaaaattaaaacaaaggaaagcagatagcaagtccatttgattcagccagtgtcactgcctttctttgaactgtcattctgatgtgggctcattgtggtagggtagaagagagcataagcagcgctaggtttgaatcctgtctgcattacaagctagctgtgtgcccatgggccagttacttaaccttttgctgagtctgagtctctttgaggctttgaagaaaaaggtaacatctctgtatttaatgtaaatttacagtaatactaattcgactcagtaattttatatcctttgagaaaaatcaaggttccccatattagttgaaatgagaatttgttcagctcctatttcttcatcagtaaaatagacataataatgcccacttatatactgtaattaagacccaattttccagtatgagagtagaactagattatttttcctctaaatttcagagggcttttaaatagaaaaacagactcttggggtagaaaaggcactgtggagatgatcctttccatagcagggaagtgtgacaggttccctctcagtaggcaggattgatgcacaatgaagaagaggggtggaggtgaatttatcccaacagcccatggattcccaggaaaccaggctccctgcctcctcatcagagaaggagtgactcttcagtcagtggctctcagtgggcacaagaatagcagcaggaacaagattttgttatgtgtcttaggtcattttggagaatcagccttcctttctgtggtgctagctggggttagtcctgacggatcctaaggactgggtgcctaggggccattcctccctggggtctcagtggtgacagggctttccttaccccaagccagacaccaacctacactttaaacatagctcttggaggcccagttcattattgcagtgttatgtcagttgcacatttaagacttaccggcttttagctactttagggaataatttattggccaaagaaagtaagtctggttataaaatggcactttccagggaggtaccgggccccaaggtggaggctgtcgaggggacccgtttccaaggtccttcttcctagagtatgtgctgagggctgacacacacgtgcagtgtgagtcactgctgagtaatatgcgaagcactaccaactgctgctcaggcccagagctcagtgcgtggtggccacctgtcggtttcacccttccccacccccatgttgacatacatgtctaatttttctctttgtttctctgaatattatcatccatgttgtcagatgaaaattattaaaacattttctatatctgagcatgggttcctatgcatgagattatgaaaaacactaataaacaatagttgaaaacctaaaacagcgtaagaggctactttgatgacttctagctgttatagaagatgttgagaagaacatggagaaaaattaagcctgtgcagaaaatctctatgccctaattggtgtatagtgatatctcattatggttttaatttgagttcactgctaatttttgccttcccttttgggttaggcagaaatttcttagatgtgacaccaaaagcatgatctataaaagaaaaaaaattggtaaattggacttcatcagaagtaagaacctctgctccacaaaagaacttaaacgaataagaagctacagacgaggagaaattaaatgcaaatcacatatccgtttaaagatttgtatctagagtatataaagaatttttaggcaataagaaaaaaactccatttttttaaatgggcaaaatatttgaaaagacgttttaccaaagatgatatcaagatggcatgtgaaaagatgtttaacatcattaatagggaaatgcaaattaaaacgacaatgacatatcattatataccaattagaatggttcaaaacaaaacaaaaacaaaaactgatcattcccagtgtgggaattcaaaatggtaccgctattttgaaaagttgtcagtttctcaaagttaaacatacatttattatgttatccagtgtttttcactcctagatatttaccctaatgaaatgaaaacaagctcacacaaaaatctgcataggaatgtttctaatggtttcattcataattgccaaaaactggcaacaaaccacatgttcttcaactggtgactagctaaactgttgtatccgtacagtggaataccatttagcagtacagacttcttatgcatccagcaatatgagtgaatcttaaatgcattatgctatgtgaaagactcaaaaggttacttatgctatgattccatttatatgacattctggaaaaggctaaactatggggacagaaaaacagaccagtagttgcctgagatcaagggttgactgtcaagggatgtgggagatattttggagtgatggaactgttctacgtagtaattgtggtgagtacacacatgcaactgtatgtgtttgtcagtgctagcagaactacactgaaaagagtaaattttactgaatgtaaattataccttaatttttaaaaatgaggaaacatatgcagacagacaagagagaaatatatagataacatgtaactggaaaacatggtttgtgatgtgtctccttttgtagttttatgtaatgagaaaaggcaggcaaggtaaagtcaattttggaagaagctttcatttcaggtatctgaacacttaagagtatttttattttagatcacctttcccattcttggggcatatcaccccaagggcatcataatgctttcttgatctgtggcatgattgccacttgtgtaggcatttactgtaaatgcataagaaacttccatttagattaggtattcacaaggaatgtttaacagtgagtgtgcccagggattgggattagactgttcagggaacttctttatcctttgagattttattatttaagaaaattaatggcaaaaaaatatattttaaagaatcgctaactcatttaccataacattaaatgacaaactctctgatatattttaaatgtggtatggttcactaaagtttagtttcacatgattttcaggaaaccatctcctgtataacattaattacatctctactgctacctaatgattagaaaaatttcctttctgttcttttttttttttttttttgagatggatttttgctcttgttgcccaggctggagtgctggagtgcaatgacacgatctcggcccaccgcaacttccgcctcccgggttcaagcagttcttctgcctcagcctcccaagtagctgagattacaggcatgtgccaccatgcccaactaattttgtatttactaaagagacggggtttctccatgttggtcaggctggtctcaaactcccaacctcaggtgatcctcccacctcagcctcccaaagtgctgggattacaggcatgagccactgcgcccgactcctttctgttcttaacatttaatatcattgcagaaattcaaaataaaaagtcaacatctgttttatgtatagtcatgattttactgacttgatcaagtattttttaaaattcttgaaaaaatcagttcttaaatcggttaaaatgattatttgctaaatgatattactaaaatattgttaaaaatgtgtgcttttatatacgtattacttcctagtattaaaaataaatggtgagaaattattatagatgctacagatttttaaaatatttgtatttctggcttcctatttttaatctgtttttctggaaagttcacagatatttcttgagtatctactagccaggcactttgtcaagtactaataataattctaattattgtataggatttaaagaaccaatacatacagcatcttattcttcagaataaccctgtgaaagtagaggataagtttagagatgctaaattcatttctttgttcatttattcacccaattattcttcaacaaatgtttaaatgagttcctactctctaccactccctgacaacactaggggcataaggatggctgagacagtctctgcctttaagaacctccataatttgtcattcaaggtcatgccactagaaaatggtggagccggccgggcgcggtggctcacgcctgtaatcccagcactttgggaggccgaggcgggcggatcacgaggtcaggagattgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccaccactgcactccagcctgggcgacagagcgagactccgtctcaaaaaaaaaaaaagaaaatggtggagccaggtcttctgattcagtactctttcttgttgccacagtgtctttcaaaataagaaaatggcctgggattaagaagaaggtggatttttaaaattattataagttatgaaagttctctgctctagggaacacagaaataataaaaatgagaccaagaatgaaccttgttgtctttgttccagagcagcagcgtctgcttggcaaagtttagcaacagccactagaactagaaatagaacatgtcacttccttttggagtctggaactgatcaccctcatctgtaggaaccttagatggctcttagtgtttgtcctggagggaaccccaagagccagagcaatccaggatccccattttacagtggaaactccctggccatccttcccttggcaagaataggctgagtcagaacagggactactgggactgtgtcatcctggaatccagtcttttcctctcctttacaccaggaatagaatagatttcctggcatcagatgccagagagacgcatttactgttcactgtgtgtaagttatcagaatcagaagtactactaacaactctcagcaaaaaggcattgggacaaaggcaatgaggaacagttgtttctgaggtagcttcactttatgagaatgagcagcaagggaaatttatggtgaaggaaacagtttctatgttttttgtataattaatagcttcttcaagatgtcacagcatctgggtggcttttgagaggagcacaccattctcttggcctgggctgttggtcagtggttccttctagggcctaagttcaataggcaatatagacatgtgccagtaggccattccaagccagagctataacgaaatatcagaaatctcagatagtgcttcagacaatgtgtttatgtccgtttcatctccgtcctgctccagctgtttctttaccttgtacaggtacctgtggaaaagtgaaaagccactctactactcatttgtcgacaaaccagtagcatataaaaaaagaggtaagtcaaattttgtctttttaataccaagtagcaacacagttgtagaaaaattaaatatctggacttgaaatgttgaatgcttaagttttttactttttttaaacaaatgttccagggcacatgtacatccaaaggagcatcatactctgcaagaaatctctgcaggaatctacttcaggaatatgtcgttcttcaaaacagagcctcagttcctgccaaaatctaaaatcctaaatcgttatgattttggaaattctttgcttatagaattccttttagactgtacattctttttgaagtaaggtttcccccatgcacctcatccagtttcattttcccttaacgttatcctgttacattactgtggtacatctgcgaaaactaaggaaccaatattggtacattcctatcaagtaaattccaggctttatttgtgatttaacattacttgttattttgtttcctttttttctccggttccagaaatggtggtgaatctacagaaacaatttagcacactggtcgagtcaacagcaactgctggaaaaaaaagcccttcaagttttcagttcaactggactgaagaggacactgatagaacgtgtttccatggacacagccttcagggagtcctgaaagagaaaggccaatcactgctgactaagaattcattatattggcttagtacacagaaattctgcagatggtaataatgcttttagaaaaagtcacatataattgaagtagttgactgtataagagccagataggttttttgttggaattagaagctggtgagcttaaagtcacgaaaatcagaattatacattgagtcttgtgtaggagttctaggaaagctggtaaaaatcaagaaagaggatacagggcaattagcacaaactatcccctctagctaaattaacctgcagtgtggcaggcaagcaatagaagtggctgtaaatgctgatcaggagaatgtgctgtattttttagtacatatcacttctctgagtcagttacctttatcatgtctttctacctcttaatacttccttaagtatttcctaaaaataaggatattctcttaagtgaccacagtacagttatcaaactcaggaaacttaatactgatacgatacctttatctcacccacagtccatattccaattttctcattagacccccagtgtccttttatagcaggatcaagttcaggagtaggtatggcattgattgattttatctcttcggtctcctttaatctgattgtccctcagcctttctttgtctttcatgacattgagctgtatttttcagaaatgtcagtgatgttacacaatgtttctgagtatggttgtgatggttcctcatgtttagattcaggttctgcatccctggccaaaacaagtgccgtgtcctcctcagggtatcatttctcagggtatggcgtctgtagactggggcggggggcggggggtccatttgcccctcaggtgttaatagtgatcacccagtcaaggtgctgtgtcgtttttccacagtgtagttactatgtttccccttacaactaataaaaaatctgcagggagatacttggtcagtgaaatactctgatcttcattcaactttgtccccttgatttcatgttttatgttctgtcctcgtatctgtcgagtgtgggcatgtgaagtctagaaaacaacacgcgcttttatggttattgggtctggataaaataggactaaagatgggaagctgcactgaggagaggaatctgtgtaggacatagtggaaaacttgtatgtctaaatagtaagacacaggcttttgacttcatcaggtttaattaatgatcggctctgtggcatactggctcttagacttccggcttagtaataggctgccttcttatttttgctttattttttcagaagagttatatattccctataaacggtcgatattggaataatacagtgtaaattcttaagtaatttatgaggtcttgctgtgtcacccaagctggagtacagtggcacgataatggctcactgcagcctcaacttcctaggctcaagcaatcctcccacctcagccttccaagtagctggaactacacgtgtgcaccaccatacccagctaattttttattttttgcagagacgagggtctccctatgctgcccaggttggtctcaaatgcctgagctcaagcagtcctcctgccccagcctcccaaagtgctgggattacaggtgtgagccactgcgcccagccatctattttcatatgactcagaaaatttcctcaggcagtagatagtgaagaacatattactccccagagcacattcgtttttctttaattgtactgaaaatcaactccaaaagtattttttgagtacttgataaaaataagtcattatcctaagtcctagatagatacaaaggtaactcaggaagtttgttttccaagtccacttgaagagaagatttttttaataagagtatgttttccccactttccttctgtagtgtcttaatagctgtagagaggagtatatggattaaaaattacagagataatcagtggggtatacaggtgtttaccataaaattctttcaactttgctgtatgattgaaattttttataataaagtttgaggagaaaaactaaaaagattcaggctatgccatgaagtttttttctccttgcctattttaacttttagttccgttttatataataatagcgaaaaggccattcaataaaatagttctgtgactttgaagttactttacctttcagtgtcttcctgttaaaaataaaaagactagactaatattccctcactaaagttctcagtaattaacgtgtgaaaaataaaagcataaaggcttttctcattgtgactatatttaaagtaatctcatccccatattgacatagaaattgcccaagaggaaattttctagtagctaagaggacttgctatagaatcatagaatcgggctgtttctatcctaagtctgccacttgctaattgtaggaaggttactcacttctctacagctgtgctgacccagttgtaaatgtggggataatactgatcttttcctcttctcaaaaccttcagtggctcccatctcattgaaaggaagacccaaaaaacattgtggagccaacacggccctcttgaccttccctctgctgtcctctgacctccttgctgtcaccctatgttcagagtgacctcccagctgctccttgagcttaccagacactccccacatgggcctttgtacctgctctgcctcctgcctagaatgttctttcccccatgtatccacatgggctcacttctttcaggtttttgctcaaatttcacttccttggagagatttttctcagccatcctgcctaaaatagcaccaatcattcccccaacacccctcattattctctgtcccctggcctatttcatttttctttgtagttttcatcactatttaatagaatatattattatatatttattttgcttatttatccatctccccacactagaatgtaagggccttgagaatgtaaggactactagaatgtaaggaggactctgttttatttaatgaaaaatcccagcggctagaccagggcctagcacagactaggtgcccaccaagtatttattgaatgaatgaatggaaaatagggcctaccccaagttcttgtgagaattgaatgaggtatttgatgtgtgtcacatagtaagtactcaatcaaacataagtatgaccattattattttaaacaaagctaattttctgttaactaatgttatttcctggtctgggcttggtggctccacctgtaatcctagcacttagggaggctgaggcaggtggatcacttgagtccaggagttcgagaccaacctagccaacatggcaaaaccctgcctctactaaaaatacaaaattagccgggtgtggtggtgcacgtgtataatctactcgggaggctgaggcatgagaatcacttgaacccgggaggcattggttgcagtgagctgagagcacaccactgcactccagcctgggcgacagagcaagactccatctcaaaaaaaaaaaaaaaaaaattatttcttaagttggtatcaatcaaagataattgaactgtagaaaatacagtgggagatgataaagttgtctatattaagatttgctgcttaaaaaaaaagttgagctgcatctacaacgattaaagagtggcactgttggccgggcacggtggttcacacctgtaatcccagcactttgggaggccaaggcgggcagatcacctgaggtctggagttcgagaccagcctgaccaacatggagaaacccctgtctctactaaaaatacaaaattagctggatgtggtggcgcatgcctgtaatcccagctacttggtaggctgaggcaggcgaatcacttgaacccaggaggtggaggttgcagtgagccgagatcacgccattgcactccagcctgggcaacaagagcgaaactctgtctcaaaaaaaaaaaaattgatttaagagtggcactgcttaatagcagccacggggaaaggccagaaccccaacccagggtcagcgccatgtctgaggtaatcgattcctttgcattggtcatgtcaatgattttcagattttatcctgaagaggagaaagagttatagtccccagtgaagagtgcttgcccacaactccaagtgaagacatggtgtgccatgccctgcctcctccagctgcagagttggtcctgagcagcttatgtcgtgatccgtacctttgtgctttttcacagggcaggagggtggattgtggattatctcagatttaatactgcagtataatgcagtgagttatacatagagcttagtatagtcagcgatgaaactgctgagatttttttctctgcatgaagtataaaactaaattctaactgtatgaagtttcagtgataccatgactttaggcaccaaacttatctgtcaaccttacctgttctagaccagagcctagaactgcagaggaagcaaaaaaggcttcagctgggcagtaaaaatgccacagagaccgtgactaaaactcagccttttttctcagagagccccttagcccctcgctcagagcccctgactctgcccttaggctgagttgtctgatttccaaactcctcatcatcaaagaaacaaaaggagaggtctgagaagcactctgctgatagacatcttgacggcaaacataaatgacaccctttgacaacaataggggagccaacatcagaatccaaagcagacagagctccagtcgcagagcctgaagttcatggctccatgccactaaataaggggaccacatccctgcttcagcacagcacctgtcctaagacgctgtgtgccttcgtggtgggttttattagcatgttttctaatgtttctacaataaaaacaggcaactgtaataatatcattgtaaaggctaaaatatgccgaatatgctctaagacaaccattgaaaatgattacaatgaaaagtgatgcttatgagagcaaatatttagctatgtatcgaattttgttaggcagaaggactcatttctgagtgttcagaagaaacaaaacatttgctgtaaaattgtgaaaacactcagagcttgggaactaagcagagaaaggccacaagagtacttcaggtatgggaggctgtttattcttcctagctgaggcagagttaacaatttcaatgaattgaaatgcccttactattcctccaattgttataacagttggctaggtcagaagacctgacttcttgtaggtggtggccgtcacctccctgggagttccacagatgaggcagagcagtggtctttagttgtattccacaggaaatggaagtgctttggcagccccacaaaaatgtgattttaattttttaaaaattattttttaactatttttttaaactatagtgaaaaaacagtactcaggccgggcagggtggctcacacctgtaatcccagcactttgggaggccgaggtgggcggattacgaggtcaggagatcgagaccatcctggccaacatggtgaaaccccatctctactaaaatacaaaaaattagccgggcatggtggtgcatgcctgtagtcccagctactcaggaggctgaggtaggagaatggcatgaacccgggaggcggagcttgcagtgagccaagattgtgccactgcactccagcctgggtgacagagtgagactccgtctcaaaaaaaagaaaagtgtaagtactgttatttttttccgttttacagatgagagaaccaagagtagttacccatagtcacagctaatgggtggcagagggttttgtttggttggttgattggttttgggtttttttgttttggggtgtttgttttttttttgagacagaagctcgttctgtcacccaggctagagtgcagtgacacaatcttggctcactgcgacctccctgggttcaagcgattcttgtgcctcagcctcccgagtggctgctactacagacatgcgctaccacccctggctaatttttgtatttttagtagagacggggtttcatcatgttagtcaggctggtctcaaactcctgacctcgtgatctgcccgcctcggcctcccaaagtgttgggattacaggcatgagccactgtgcccaaccaagtggcagagttttatggtgcaaacatagacattcaggaatttagggccgtatatattatgtaaatcataatatctcaatgtctatagcttctatatgttatttctttacttgctttttaaagttgataatgggaaatttctggtatactcagaagtagagtagtataaagaaccccccgtctctgtcactcaatctcagcaactgtgacatggcaagacttgcttcacccaggctccagcttactctacccctctgccccccattatttggaaacagatctcaaacatcatattttttaaagtaaaaccataataccattaatcagatataaaaaattaagtcatttcttaatattctccaatatgcagtcagtgattagatttttccctattgtcataaaattttttaaatgagtttaactcagaatccaaatcaggcccatatattgcaagtggttgacatggctcataagtgtttcagttcttaaggccccacctctttatctctctcttttttcttcttacaatgtacttactgagtaatcctggtcatgtgtcccatacaatttctcatagtccagattttgtgtatagacagtgccatatgatgccatctaacctcttcctctatccctggatagcctatatgttgatgtagttagtttgagattggcagttatggccaggtgcggtggctcatgcctgtaatctcaacactttgggaggctgaggtgggtggatcacctgaggtcaggagttcgagaccagactggccaacatggtgaaaccccatctctactaaaaatacaaaaattagccgggcatggtggtgcatgcctgtagtcccagctacttggggggctgaggcaggagaatcacttgaacctgggaggcagaggttgcagtcagcggggtgagactctgtctcaaaaaaaaaaaaaaaaaagagagattggcagttaacattagttagagatttgatcagattcaggtttaactttttttttatatatatactttaagttctagggtacatgtgcacaacctacaggtttgttacatagatacatgtgccatgttggtttgctgtacccatcaactggtcatttacattaggtatttctcctaatgttgtccctccccctgcccccaccccacgacaggccccagtgtgtgatgttccccgccctgtgtccaagtgttctcattgttcaattcccacttatgagtgagaacatatggtgtttggttttctgtccttgtgatagtttgctcagaatgatggtttccagcttcattcatgtccctgcaaaggtcatgaactcatccttttttatagctgcatagtattccatggtgtatatgtgccacattttcttaatccagtctatcattgaaggacatttgggttggttccaagtctttgctattgtgaatagtgccacagcaaacatacatgtgcatgtgtctttatagtagcatgatttataatcctttgggtatatactcagtaaggggatcactgggtcaaactgtatttctagttctagatccttgaggaattgccacactgtcttccacaatggttgaactagtttacagtcctaccaatagtgtgaaagcattcctgtttcttcacatcctctccagcacctgttgtttcctgactttttattgattgccattctaactggtgtgagatggtatctcattgtggttttgatttgcatttctctgatggccagtgatgatgagcattttttcatgtgtctgttggctgcataaatgtcttcttttgagaagtgtctgttcatatcctttgctcactttttgatggggttgtttttttcttgtaaatttgtttaagttctttgtagattctggatattagccctttgtcagatgggtagattgaaaaaattttctcccattctgtaagttgttcactctgatggtagtttcttttgctgtgcagaagcttgttagtttaattaggtcccatttgtctattttggcttttgttgccattgcttttggtgttttagtcatgaagtccttgcccatgcctatgtcctgaatggtattgcctaggttttcttctagggtttttatggttttaggtctaacatgtaagtctttaatccatcttgaattaatttttgtataaggtgtaaggaagggatccagtttcagctttctacatatggctagccagttttcccaacaccgtttattaaatagggaatcgtttccccacttcttgtttttgtcaggtttgtcaaagatcagatggttgtagatgtgtggtgttatttctgaggcctctgttctgttccattggtctatatctctgttttggtaccagtaccatgctgttttggttactgtagccttgtagtataatttgaagtcaggtagtgtaatgcctccagctttgttctttttgcttaggattgttttggcaatgcgggctcttttttggttccatatgaactttagttttttccagttctgtgaagaaagtcattggtagcttgatggggatggcattgaatctataaattaccttaagcagcatggccattttcacgatattgattgttcctatccatgaccatggaatgttcttccatttgtttgtgtcctcttttatttcgttgagcagtggtttgtagttctccttgaagagatccttcacatcccttgtaagttggattcctaggtattttattctttttgtagcaattgtgaatgggagttcactcatgatttagctctctgtttgtctgttattggtgtaaaggaatgcttgtgatttttgcacattgattttgtatcctgagactttgctgaagttgcttatcagcttaaggagattttgggctgagatgatggggttttctgaatatacaatcatgtcatgtacaaacagggacaatttgacttcctcttctcctaattgaataccttttatttctttctcctgcctgattgccctggccagaacttccaacactatgttgaataggagtggtgagagagggcatccctgtcttgtgccagttttcaaagggaatgcttccagtttttgcccattcagtatgatattggctgtgggtttctcataaatagctcttattgttttgagatatgttccatcagtacctagtttattgagagtttttagcatgaagggctgttgaattttgtcgaaggcctcttctgcatctattgagataatcaggtggttttgtcattggttctgtttgttgttgttgttgttgttgttgttgttgtttagagacggagtctcgctctgtcgcccaggctggagtgcagtggcacaatctcggctgactgcaacctccgcctcccgggttcacgccattctcctacctcagcctcctgtgtagctgggactacaggtgcccgcctccacacctggctaagtttttgtatttttagtaaagacggggtttcaccgtgttagccaagacggtctcaatctcctgacctcgtgatccacccacgtcagcctcccaaagtgctgggattacaggcgcgagccaccgtgcctggcctttggttctgtttatgtgatggattatgttattgatttgcgtatgttgaaccagccttccatcccagggatgaagccgacttgatcgtggtggataagctttttgatgtgctgctggattcagttttccagtattttattgaggatttttgtatcaatgttcatcaaggatattgatctaaaattctctttttttgttgtgtctctgccaggctttggtatcaggatgatgctggcctcataaaaatgagttagggaggattccctcttttttctgttgattggaatagtttcagaaggaatggtaccagctccttgttgtacctctgatgagttcggctgtgaatccgtctggtcctggactttttttggttggtaagctattaattattgcctcaatttcagaacctgttattggtctattcagagattcagcttcttcctggcttagtcttggaaaggtgtacatgtccaggaatttattcattttttctagattttctagtttatttgcatagaggtatttatagtattctctgatggtagtttgtatttctgtgggatcggtggtgatatcccctttatcattgcatctatttgattcttctcttttcttctttattagtcttgctagcggtctatcaatttttttcatcttttcaaaaaaccagctcccggattcattgatttttttaagggttttttgtgtctgtatctccttcagttctcctctgatcttagttatgtcttgccttctgctagcttttgaatttgtttgctcatgcttctctagttcttttaattgtgatgttaagatgtcgattttagatctttcctgctttctcttgtgggcatttagtgctataaacttccctctacacactgctttaaatgtgtcccagagattctggtatgttgtgtctttgttctcattggtttcaaagtacatctttatttcgttatttaccccatagtcattcaggaacaggttgttcagtttccaagtagttgtgcggttttgagtgagtttcttaatcctgagttctaatttgattgcactgtggtctgagagaccatttgttgtgatttctgttcttttacatttgctgaggagtgctttacttccaactatgtggtcaattttggagtaagtgtgatgtggtgctgagaagaatgtatattctgttgatttggggtggagagttctatagatgtctattaggtccacttggtgcagagctgagttcaagtcctggatatctatccttgttaaccttctgtctcgttaatctgtctaatactgacagtgggttgttaaaagtctcccattattattgtgtgggagtctaagtctttgtaggtctctgaggacttgctttatgaatctgagtgctcctgtattgggtgcctatatatttaggatagttagctcttcttgttgaattgatccctttaccattatgtaatggccttctttatttcttttgatctttgttggtttaaagtctgttttatcagagactaggattgcaacccatgctatttttgctttctatttgcttggtagatcttcctccatcccttttttttgagcccatgtgtgtctctgcatgtgagatgggtctcctgaatacagcacactgatgggtcttgactctttatccaatttgccagtctgtgtcttttaattggggcatttagcccatttacatttaaggttaatattgttatgtgtgaatttgatcctgtcattatgatgttagctggttattttgcctattagttaatgcagtttcttcctagccttgatggtctttacaatttggcatgtttttgcagcggctgataccggttgctcctttccatgtttagtgcttccttcaggagctcttgtaaggcaggcctggtggtgacagaatctctcagcatttgcttgtctgtaaaggattttatttctcctccacttatgaagcttagtttggctggatatgaaattctgggttgaaaattcttttctttaagaatgttgaatattgtcccccgctttcttctggcttgtagagtttctgccgagagatcagctgttagtctgatgggcttccctttgtgggtaaccgacctttctctctgactgcccttaacattttttccttcatttcaaccttggtgaatctgacagttatgtgtcttgggttgctcttctcaaggagtatctttgtgtggtgttctctgtatttcctgaagttgaatgttggcctgccttgctaggttggggaagttctcctggataatatcctgcagagtgttttccaacttggttccattctccccgtcactttcaggtacactaatcaaatgtagatttggtcttttcacatagtcccatatttcttggaggctttgtttgtttctttttacttttttctctaaacttctctcttactttatttcattaatttgatcttcaatcactgataccctttcttccacttgatcgaatcggctattgaagcttgtgcatgtgtcacatagttctcatgccatggttttcagctccatcagatcatttaaggtcttctctacgctgtttgttctagttagccattcgtctaatcttttttcaaggtttttagcttccttgcgatgggtttgaacatctgcctttagctcagaaaagtttgttattgccgaccttctgaagcctacttctgtcagctcgtcaaagtcattctccatccagctttgttccgttgctggcaaggagctgcaatcctttggaggagaagaagtgctccagtttttagaattttcagcttttctgctctggtttctccccacctttgtggttttatctacctttggtctctgatgttggtgacctacagatgaggttttgttgtggatgtcctttttgttgatgttgatgctactcctttctgtttgttagttttccttctaacagtcaggtccctcagctgcaggtctgttggagtttgctggaagtccactccagaccctgtttgcctgggtatcaccagtggaggctgcagaacagcaaatattgctgcctgatccttcctctggaagctttgtcccagggggcacctgcctgtatgaggtgtcagtcggcccttactgggaggtgtctcccagttaggctgcacgggggtcagggacccacttgaggaggcagtctgtctgttctcagagctcaaacaccatgctgtgagaaccactgctttcttcagagctgtcagacagggacgtttaagtctgcagaagtttctgctgccttttgttcagctgtgtgctgcccccagaggtgtagtttacagaggcagcaggccttgctgagctgcagtgggctctgcccggtttgagcttcctgaccgctttgtttacctactcaagcctcagcaatggtggacgcccctccgcctgccaggctgctgcctcgcaggtcaatctcagactgctgcactagcagtgagcaaggctccgtgggcgagggaccagctgagccaggctcaggttataatctcctggtgtgccgtttgctaagaccattggaaaagcgcagtatttgggtgggagtgtcccgattttccaggtacagtctgtcatggcttcccttggctaggaaagggaaatcccttcccaggtgaggtgatgccccgccctgcttcggctcaccctccgtgggctgcacccactgtgcagccagtcccagtgagatgaaccaggtacctcagctggaaatgcagaaatcacccgtcttctgatcatgctgggagctgcagaccagagctgttcctgttcagccatcttgtaacggaaggctttcctattttaaaataatggaaattgcttggtaaactcttctctcacaatacatatagtattgcaagctacattataaagtctagtgtcttattttgggtggaagtcaggaattatttgttttctttagtttgttttagaaatatgttcagaatctctccctgtgtgcttttgtttgccttgaccatggtaagaaagtggagtggtggcccatctggagtgaagaaactttgagcaaagagttgaaggaccagctcttagcaccacctgtggcccttgtgtggtggccatggacagtgtgaacatgttttcctttgtgcagttaaggagttaacaaattcttctaagtttccttccagctcagggtcctgttttaagcctaaccatatatatttgctaagttatttggggggatgttcaggggttagtgtgtgcatttcttggttaccatctaaagataaattcttttttctttttcccttctagctattgtacacatgtgacaacctatgaagaatcaaattattctctgagttatcagtttatactaaatctcttctccttcctgctcagaataaagacttcccttctccatgaagaagtgagcttagttgagaagaaactttttgagaaaaaatacagtgtaaaaagaaagaaatcaagatccaagaaagtgagacgacattgagaaaatgaaatagaaactttctggaaaaatattttaatagtgataataacatcagattttaatataacattccagagaattgtggaaaatactgcatatatatgtatagactctgacacatatttacatatatatcaagtgtgcttagaaaaatgtatattgtaaagcaggtgagcttcatttgattttatttttcagagtatgaacattctaagagaaagttaaaacaatagcaaattgtataattgtatccagaaatgtatactcatcgtattttaaagctaaatttattttttaaactagatcccttcattattctttatgccccagagtaaatcccagatggatcaaagatctaaacataatctttcatatgtaaaaatataaaagtattagtagaaaacaaatatgaatgctttgatgatcttggaatggcaaagtcaatttttgcagcatatggtggacaaagaaataatttctttaatgtatcaatagctcttgcaaagcaaaaggaaaaaagcaaactgagtaagggatatgaaaaattagttttctgaggccgggcgcggtggctcacacctgtaatcccagcactttgggaggccgaggtgggcggatcacgaggtcaggagatcgagaccatcctagctaacatggtgaaaccccgtctctactaaaaatacaaaaaattagccgggcatggtggcgggcgcctgtagtcccagctactcaggaggctgaggcaggagaatggcgttaacctaggaggcggagcttgcagtgagccgagattgcgccactgcactgcagcctgggtgacagtgcaagactctgtctcaaaaaaaaaaaaaagaaaagaaaaattagttttctgaaggccaagccaaaaaacatcataggatactcgacctcacttatactcaagaaatacaaattgaaatgaatactgtttcccacatactggattggcaaagattataaagatgtgtaaaacctggtatggacattggaaaatcaggcattcttgttctgagttcatttatgcatgcaacagatagcaactcctgtgttcaggcatgttctaagcactggggatacagcactgaacaagacccccacctttaaagatcataggttccaactaggtgaaagctgatagtaaaaatatatattatttttgagggaattaagtacaatgaagaaaaagcaagaaaagataaatgataaggtaggccattttttaaagggcggctgagggaggatcctctggggcagtggcattagagcagagaccaacttgcctggaacacagtagcacgagcagccatgcagccatccagggggagatcagcccaggcagaggaaagatgtgcagaggttctgagcaggggcatgctggatgcagtcaaggactggcagggtgtccagagtggctggagcactgtggataaaggggagagggagagcagatgggcaggtgggatggtagaggttgctctgaggtcacggtaaggatgaccttaccacggttggcttttttctcaaatgtcacaggaagccactggaaatttttaaacaaaagaatgatgtgatccaacgtatatcataaaagtatcactgactactctgatgagtacaccgtagtggggatgtgagcagtggttagagagttcattttgaattgaatgtattttgttactctctacctgtttcacttattgtaaggttttcttttttcttttctttttttttttttttttttttttttttttgagacagggtcttgctgtgtcacccaggctggagtacagtggtgtgaccttggctcactgcagctttgactccctggctcaaatgctcctcctgagcctgactagctgagaccacaggcatgtgccatcatatccagctaaattttttattttttgtagagacagaggtctcagtatgttgcctaggctagtcttgaaattctcggctcaagtgatcctcccacctcagcctcccaaagtgctgggattacaggtatgagccaccacgcctggctgactacaacttttaatattttttaatttttgcaactttttttttttttttgagacagagtctcactctgtcgcccaggctggagtgcagtggcacgatctcggctcactgcaagccccgcctcccggcttcatgccattctcctgcctcagcctcctgagtagctgggactacaggcgcccaccaccacgccagctaatttttgaatttttagtagagatggggtttcaccgtgttagccaggatggtctcgatctgacctcgtgatccacccgccttggcctcctaaagtgctgggattacaggcgtgagccaccgtgcccagcctaatttttgtaactttttataatgagacttacacattgatttaaattatatacaggatgctcagccagcacaaagctgtggtgagatttgggcccaagtctccgactccagattccaaaccacattaaaaaaaaaaaaatcacctgcagactgcctatagctttaacagtctctgtctccccttcttcacatccttccggtggagaaaagtttgtgaatattaagtaaatttgattcaatagacattttatttttttgtaaagatgatggggtcttgctatgctgctcaggatggtcttgaactcgtgacctcaggtgatcctcccacctctgtctcccaaagtgctggaattacagatgtgagccactgcgcccagcctggtttggtagtttcttaaaagtgaaaattagacctaccatgtgacccagccattccactactaggtgtctacccaagaaaaataaaagcatgtttccacacaaagacttgtatacaaatattcatagcaactttatttggaatagcaaaaaaaagggaaaacaacccaaacagccatcagcaggtgaatggataaacacatggtggatatccatacaatgaaacactgctcagctgtgaaaaaggaacaaactattgaaacaatatccctgttcaggagcaggatttggagaatataagaagcatatcttttataatttaaaaacttgctttctaagatttgaactgaaagatcttttttgaagatgagtgtcatggaattgacatgatttgaagtgttatggcacttcctttgaataaaaaaatcaaagttgctaacaagttccatgtacttaaaaatattgggacagagcgctcaaagctatgaaaagttttgggccacccatgaatatgagataagattaacaagagaggagaaggaagtgaaaaatatggctttccatgcatttccaattgtatgaattaccattgaaggctagtgatgaaatgttactctctaggagtcagtgttttcacatctaaaaatggtatcagtcatagaaaaagcttatctgtctactgccaaaaagggaagagggtaatagcacgtattgagcacctactgtatattcagatgaggtcctgccatacgaaattcagtccccactgttctgggggccatgcaatcgtctttagataataggtgtggggctaggggttccgctgtgaagttaccttccttcccagggtgctcagccagcacaaagctgtggtgagatttgggtccaggtctcagactccagattccaaaccacatttaaaaaaataaaatcatcacctgcagactgcctatagctttgacagtctctgtgtctccctttcgtttgcatccttcgggtggagaaaggtttatgaatattttagtaaatttgattcaaaagacatttcttgattatcacattggttctcaaagtgtggtccctggaccagtgacatcagcattacctgggcactcattagaaatgcacattctcaggcctactcctgactcccaatccagaaacacagtgtgggtccaacaatctgttttaacaagtcctctggttcgctccaggctccagggtgggacagtcactggtgcttctgctggctgggacaacagggccccactgtggaacttgcagcccgtgaccccctcctaacggctcctctcagttcccgtggtcccaaaagccctctgtcccgtgcagggctgccccacagtggccttccacatcctcctgatagcagaggcccccgccacccccagggccacctctgcagctgtgccgcagcttctctgcccaggcacctgcactgacacggagcaccctgtaggttgtctgcttgaggcctttacctaaatgcttgccgcagctgtttctaaactacaaaagcacacaatcatgaaatgaggcagaggtgggctgagtgccacaatggatgccaagaggaagagagatggacatggcgctgggaggctctgggcaccactggaggggggcgctgagttcccgggctgccccggctgggagaggagtcgagtcttaatctcctttaaggaaacataataaataaactactttgccactagagtgatttatgtgttgatttgggtggaatctctttcatgaacacattttatgtctttttaaaaaaattagattatttcttggccaggtgtgggcacagggtggctcatgcctgttatcccagcactttgggaggccaaggtgggtgcatcacttgaggtcaggagttgaagatcagcctggccaacatagtgaaaccctgtctctactaaaaatacaaaaatttgctgagagtttgtggcaggtgcctgtaatcccagctacttgagaggctgaggcaggagaatcgcttgaacccaggaggcagaggttgcagtgagctgagatcatgccactgcactctagcctgggcaacagaatgagactccatcttataaataaataaattagatttcctaccactacagtgaagcataattttatgatttaggcaactaccctaaagggaaataaaactaagtgagattccacatggtctcagtaatacctgtagtgcaaaatcaaatgcttatagggagtgaaacagaatgcggccgatacctgtggaaaagagtgcttcaattgtcttatgtctacgaccagcctaagctcatagccatacaaatatatataccatacatgtgctgaaactaagttaaatttcttgtttttaattgtcttaagtatcaaacttggatcatcagaacatgttggaaaaacacggctctgaagccaacttattaagcacctgtgctgtatcgaacattttacatttgttcatttaacatatctagataaatctactcatttacagctatagtgatccaagatttcatcacagcagattaaaacaaaacctttaagttaaaaataatttaaaatcagtgaatatattaatactatgagagtctttgcctatgagaatacagaactttggcccaaatgtttcattaatctacagggttatatacatttggagcacagttttgttgtttgtttgtttgtttttaatcctcttcccaaaaatgggtttctttaggcagctcgagactcctgtgttagacaagaggaaaaggagtgggtgcctctcgactgggaccagtggacattattatgggaatataccagtggtggcaggttgatgaccttatctccctgcagggtagtatttctctctgggctctcagcaggtctgcctgtcactgccacccagaagtggagccaccttctgaagcccaaaccgaggagggagagcccagggtcctctgaagcccaaaccgaggagggagagcccagggtcctcaggcgcctcgcagcaggaggccaggagttcacccacagtgtctagttccttgttatctttctttttccctccattggcacaaagccacctagaaaaaaaaaggagtattaattcatccctctattcacacaagaagacaacatattgtttaaataagaaaggagcatgatttcccgaatcttcagcaagaccttgaatacagtttccaaagtaggcctgctgtaaaagttctgtggattattataaactgcaggtagttaagagtgtgtgtttttatcttgagtatgtagctggtgactttttaaaaaaattaaaatgcctctgtgttcctgaaagctgagtaaattcacacagtattaagtctctcacaaaacgaattcaagcagctctaagtgtatgttcccttgtttcgtgcccttgtgaagtatttaagcataaagagctttagtgccagacttacctgataatatgctatgacttcagaagagcttacaaaagagtgcttttattgactttataaattaagaacctggtatttcagctcagttggccttctgcccttctgaaacaatcattcccttctgggacaattagtacatgttttatggatatttgcgttgaactgggtgacttgcagacactcccaaaggaatttttagttagaataccacttaaacgcagttgccttttgtcaccattgttgtccacattaatttaaattaagtaagtaagttaaacattacctacaatgaaaaaggtggtcctgaatttttaaaactccccccaaggtttaaagtaggaaaaaaatgtattctttgccatgttcgaggataagaaaatgttgtaaaacatgaatacttatttttacctttctctccttagcaactgacaccagaataaaaatctccctggaaaggctcctctggtcccaagcggtcacctgctccggccccagagcccccgggggtagggaggtgggctctgtgcctcttccccctccactgtccatcctgccacagcagttcacagggtcagctcttccgctctaaaactggttttgttttttgttgttttgttttgttgcaattgccccgtgctaagtgcagcccacggccctcatgtggaatgggaatcaggtagtaaagtcagtaatgttggtttcgcctgcccctcctcaccacagcccaagggtcagagctgtggaatggcctcttagaacccagctctatcacgccctcccatctcccactgctgcccaggaagggtagggacccaggatcctgcacccctcagatcattctgtctccactcactttcttcaattcctccgcacctacagcacagcctatttttgacattatcatagcctgcttatgtgtgtcctggtttactaactagacaggctttcgtgagacatggctcctacagaaccctaaatccaacagatgttcagtaaatgctttgatgaaagtagtgatgagaaaggggaaaattacaaaaagcttcccactttctgatcagctactgctgtactgttttcactattcagtgatttcaccattctgtgaatgggctcagttgtctgcctacaaatgttggttttgagtcaaactgaagttatttgaagacagaaggaggaaatgggcctaagtttcgcccctggcattcctgtggccatatcaaatatttatatagtgcttagagtgggccaggcatttcacatgtatggactcttttatccatacttttagcagccctacggtcctgtaatattgtacaaaggacgacctggagacacacagaggttcaattacatccccagggccgtgttggtaagcatggagccgggctctgattccaggctgttggctgaagtctgtgggcttggccagcctaccgtgctgcctcaccaagactcaacccctggtgatgtcagtttggaatctaaggagcccaaaagctgctcagaagaaaactagatcatttacaactagcatatatcctcaccacccctcctccatgcctccaccccaaacctgttcttcctctgccttccctgactcagtgacagccccgtccacctaattgcgccaagtcataaatctccagcccctccctccctgtcacctccaaatctcatcctcacttcgctgactttctaccaccaagcacctctggactccgccctccttcgacagtcactgcccagctctggcgctcctcgtgttctcccaggagctgcaaagctctctcccctccaacacacattgcccctctgccagttattttcccaaatcgggtctaaacccaccccccaccccccccacccccacaatatgcagcatcctcccaaggctcctgttgcctagaggcaagagacagtgtgttctggttgagctatcagagtgtggccccaacacttttcccatcccccgccctgccttgcgccctcgatctcaggcaagccatggcctctcacaccctgaggcctttgcctgtgttgtatgctctatcagaaatgtccttctctctcttcttcctttaggactcttgctctatgccatctcccttcaaccctccctacctcagctccccaagcagagttcatggtttccgagcacagagctcagacctccgtaagggcatgcaccgtctgtgccacatgcctgggtctctagatggagcctccttgtgctggcccatgagctttctgtgcacacagatgccagtacccacagggcaggtaggcactactgttagcgctccctccccaacctgacagcttggtagattttaagattaagaaacttgagatcttacaggaaaaatatcacaatgataatagaggccacataccaaagaagcatatctaggaaatgttacacatctagtttgtaattacaagttttatacaattaatttccacttaccagctcatcagaaactttccaggtttgctcttctctgcattttcaatgcgatgactacatttatttagctttattaagaatcctatgcatactaagatttggcttttgcatgttacctggtcctccatctacacgaacagctctctaatttcgtgtcagttagtgcctgccgtctgctgatccccataatggccccagagcagagtaacttgaggttttatgatgccttgaggaacttttattaaaaggaccacaatacctaagtaaataatgctcaaggagctccccagttctaaaccaggagagcatggttgtgcccatgataatttcaggcccaacacacacaagtctctgccactcctgaagagcaatcccaaaactccaagacctgcttcccttcttttccctctgatgcttatcacaaaattctcctgatttggccaggcacggtggttcacgcttgtcacgcttgtaatcccagcaactttgggaggtcaaggccggcggatcacctgaggtcaggagttcaagacaagcctggccaacacagtgaaaccccgtctctactaaaaatacaaaaattagctgggcgtggtggcaggcgcctgtaatcccagctacttgggaggctgaggcaggagaattgcttgaacccaagaggcggaggttgcagtgagccaagatcgtgccactgtactccagcctgcgcgacagagctagactcggtctcagaaaaaaaaaaaaactcctgatttttccctttaccttttttcagcctctagctcttcctttttctaatcatcaccaacagtgatgcccactgatttgaaagctcctgtgctgtatggaacattttacatttgttcatttaacatactagataaatctacttatttacagctatagtgattccagatttggtcacagcagattaaaacaaaacctttaagttaaaattaatgttaaaatcagtgactatattaatactacgggaatcaactcaaaagtacagatattgaaatcagtaatatcatggtttagaaaagacatatcaacatgggttgcaaaaggctcagacttcaagtaagggagctggcagctggggagggattactgtaaaaacacagttaataaaatgtcaattttggctggatgatttaatccctctttgctttttccctacctataaagcaaagataaatctctcttgtactaaaatgtggtgagatgctccaacaatttttttttttttaagatggagtttcactcttgtcgcccgggctggagtgcaatggcgcgatcttggctcactgcaacctccgcttctcaggttcaagtgattctcctgcctcagcctcccaagtagctaggattacaggcatgtaccaccatgcccggctaatttttgtatttttagtagagacggggtttcaccatgttgatcaggctggatggtcttgaactcctgacctcgggtgatccacctgccttggcttccctaagtgctgggattacaggcgtgagccaccacacccagcagctccaacaattttaaatggacattattttataatagagatgtttgatcattaataaccctttcttcaaagagtgaaatatgcacctgtgagccagcaagcctcaccacagcctctcagctcccctgtttggggtgtttgcttgaaatggcattgagccaaatggctccaccccactcggtgtcagtcagaagcaagag

SEQ ID NO: 478 - DNA, 27464 bp, Homo sapiens
tgcagcagtgggggccggccttggaccgtgatccaacccgaccatggctgcccaacccccacgggctcacctggcccctcatcgaaccatgtattacccgaataatttattctagtgtctgggcccagccccgtgtccctcactgacaaccagaccatggagggcagcccttgtgttttcccagggggaggggagggaggagggggtggattcttaaagggctgcagtgagtgtggccccaaatgcacacccagggttaggcacgcaggtgatggcacagggagcccaggttctaggaagtggcacctgcggccggggaggcagggcctggattttgctgccccctggtggctagcggcctgtccaggcaaaaggcttggacctgcagcccctgtggctcagaggaagagacagaggaagagacagacagaggtctgaggtctcccatcagaagtctcagctcccaaggcaaattcagaggtggagggtcccttggccctgtcccagctctggcagggcggccccccacgtcctggcctgctgccaggggtcgcgcccacagccctgcaccgagcagggaaggcccaggcctgggtgggtctttccgcaggatcctgggatgttgcttaggggaagccgagaccagacgggcagtcacctgtctgggaaagcaccaggccctggccgggtgcgatggatcacgcctgtcatcccagcagtgtgggaggccgaggcgggaagatcacgaggtcaggagatcgagaccatcctggctaacacggtgaaaccccatctctactaaaaatacaaaaaatcagccttgcatggcgacgggcgcctgtagtcccagctactccggaggctgaggcaggagaatggcgtgaacccaggaggcggagcttgcagtgagccaagatcgcgctgttgcactccggcctgggtgacagagccagactcaaaaaaaaaaaaacaaaacacaaaaaacaaaaaggaaagcactaggccctgcggaagtccccatggtgacattcacgtcctggccacgtgggcgggtgtaggggagggaccgcagggaggcggaagtccttgttttttcctgcagtcggcccaggcaggacctgagcagcctgaagccatgagtcgctgccactgctctttctgtgcctggtgcagccccagctcatggggtctgggccgcctctgatcccatgccccccacttcacacttggggttctggcttccccgctgtgagcctgtctctcctccgtgggacaggccagcctgggcagccatccctgtacccactgcccagcatatagtgggtgcctcataaatgtgggctgaacagagcctgcccctggggccccaccctcactgccaggcatacagcaggtgcctcataaatgtgggctgaacagatcctgcccatgggccccccgacttccagacataaagtaggtgctacataaatgcaggccaaacagaatctaccctgggggcctccacttccctttgatgggggcagagaccctctgccgggcagcggccacccagtgcctgggacaggtgcccccttctcccaccctggcctatcttggggcatctgagggaggacagggctgtgccccccacttcatcctcgagggtctggcttccccacctgtgagcttgtctctcctccgtgggaggagcagcaccgtcgttttcactttccgtgatgaccactgagtgagagaagatgacggcagctcctgcgtttaaaaaggaaccatccgcgtaactgccgcaggcagggcccgtgctcgggcagtgaggcctcggccctgagaaggcccggaccccacaggcctggccctggctgagagggagttggagtcccccgcctggggcagcccctctgcacctggggtggtggagcaggagcttggctgcaggcggggctttcctcccagctctgggagccgcttcgctgcaaacgctgtgactgcaacctccgccacccaggttcaagcgattctcccgcctcagcctcccgagtagctgggattacaaggcacctgacaccatgcccagttaatttttgtattcttcctagagacggggtttcaccatgttactcaggatggtctcaaactcctgatctcagatgatccgcacgcctccacctcccaaagtgctgggattacaggcgtgagccaccatgctcggcctaggtgacttttcatggggagataacacacaggcatggtgagcagcgtggcagaggacctgtgtgcagggccctgtctcccgccggggaatccttcatctgggaaatctccgctgcgggacagggatgctgtgtcgtcaggacgcagcgtctctccagggcacccgggcctcctctgagcctctttgcgctctttggctgcgtgctttctttcctgtggcaaaaggtacatgacgttttattgaccatttcagccattggcaagtgtgcaaatcagtggctttagtccattcgcaatgcagctggaccccaccctttcctgattcccgcaggccagggctgagggcggggaggggcctgtgcagcagcctgagaccggctgtccaatggcagagcttccttctgggaaagccatgggtcccctggggccccatgctggaaccccagcaatggtggttcacgtgtctctccatctcacttcccgtgcaaaagcgacacaggcgggtacaaacccaaacagtgcagacatggaggagacagaaggtgaaaatggtttctgagcccctccagccgccctctggggacaccagcctggcgttcttcagacacaagcactccctgcagccaggaagaggaggaggcagccgggtcttgggcgcagagggaccaccctgtgaggacatagggagcaggtaccatctgcaggcccaggagggaaccaaccccacctgcccctgcatcttggacttccagcccccagaaccatgacaccattgtgtttccatttcttgagcccccaagtctgtggccctttgctttgttttgacaccccagcaacatgagccccttcccaacccctccccagccctggccccatcatccttgacctctctctccctgcaggttagatctgcctgtcccagaatttcacctgaatcacaaagcgtggcgcctcggggcctggctcccttcacgtggcctgatgtctgcatattcatccgccgtgcagtgtgtgtccacggttcattttgtgttgccacggagcatctcattgtgtggccctagcccagtgtgttaatccgttcacctgctggtgggtgttgcagtggtttccagctcttggttatcaccgagaaagtgactgtgaacttccgcacacacgttttgctgaggacaactccttccatttcacttggttattaggagtggagttgctgggtcctagggaaggtgtgtgtttctctctaaaagaatttgccaaaccgatgtccaaagctgtaccatttcaggctcctgcctgaaatcatgctgtgattgtcatttcagggtccacgtctgacaagtccaccgtggctgcccttctgggcctgttgctgctgactcacgttcccacggccacctttccctgcgtctggacgtagtagcaatttctcgttggatgtggacattgtgctgtgaccgctttgatcacctggcatttttgttgggttgtttttggccttcctttaaaggacgctgcgctgtgttctgcgtggagttcagctccttgctcttcactttggtcttcgtgtggctggttctgaagcctctcagagcaggtccagcccagcctttcctgcaggaagagtccagccccactcccaggacgggccctgctgggtggctgccaacagcccaggatcctccaggactctccccctggcggttggaactcctgtctcccacctgtgagtcccaggggccgggggtccacagccccctagggtcccatccatgctgaagagtccaccttccacatccatggcgcctgactccggaggcctcagaggccctcaggcagccttctggagctttctgtctgtgcagttccctcccttctggagctctgcctgccaggtccctctgcggatgtctccctgagcactgacctccttctcctcagcccgccaggactgctggacctgcctggatgcccgcccctgctcggccatcctcaatgggcctccaccccagggctggggtgacccgggctgaaaacagttcatcctgagtttcagtctcgagctttcgtggcaggagggaaactgctggctgtgttactccacggcggctggaacggacgggaccagctcccttcagaggggcacttcggttggttctagaattctcctttgctatgaaggctgccgggcacattccacaccagccaccctccacctcgcatgtgcgtttatcgatgaaacgccacagtgggacctcctggatcaaatagtgcaatgatgtaaacgcttagtattgtcctggaacctgcctccgaaaaggccgtgcgctcccgcctgggatcctgctgctcctccgccggccgccccgcacacgctccgctgcctctctgggctggctcagccgttgcatgttcctgcgtgtgcactgagacgtccaccctggcacgcttcttcccctcggcacgtggtccccacgctgtgcctgcccagctcggagcccagaggcccccgcagctccccacaacttcatggtgcagtgacctgaggcctcccctggctcagtccctttcccagggtcaggggtccatgtattgaaccaggacgggaggtgccttccccctgagctctgtccctgctgaacctggaaggcagcgcccggtggcggctcagacccccagagcctcttctgaggtccgacactcctctgctccccccagggagaccccctggcctggcccccagctctcggtgcctcggtttcctcacctggaaggtggggatgttgaaggtgcctggcctgtggctgtgcactaagctagggtgactgtgagcttccagagctcgaatgtctggaaggaagggcgcgagctgggtgcgtgtgagtgtcctgatcatggacacagagcgtggggccccttggagggctggaacccaggtgggggatgcctgggtggtgggacagagtggggctggaggagagggtctgaggaatgttccggccacagacaccccaagcccacgggaggtcaggagttggtcacaaggaaggtgaggtggggaacagagctggggcccagggtcctgatttggggtgagaggtgacgccatccccgagtcagaaagacggccaggggaggggaggaggtggggaaagcagacagacggggaggcggggggagcccagggccaggagtgtcaggggcaggcacttgagacagaggcaccctgaggtttcccagcaggcaattgataccctggcctgcagcggggaggaaccggggctgggctggaggcctggggacgcctggggctgccccaattcccagcagacacctcaccctctgggaagccccagctgccccagatccctcccacaatgctctgaccacccccaacccccaagtcctctcccttctgtccccaagcccgaggccttggagctgcccccgccctgggccatgagagctggacacagagccctccaagttccacgggcctcctgcaccgccgcctgctccgccctcctgccctccccctcggcctcccctgtgagggctgcccacctaggtgaccccggagccgcctcctcacgcctccatctgctctgcacaccgtccactagcctgacagctgcccaaagcctccagagcacagaacgggcctggtgtctgcgcctccgtctcggggtgggccacggccggttctgtgtcccgtcccctccccgctcaccagcggtggaccccagcttccctctgcagcagcactcaactcatgcactttcttgcagacgcgcagcccacctcgcccccgcaggttcctcttcattcagagccccccatggcctgggcagtccatcctgagtgtccgcaccacacgactgtagacgtttggcttctggactcaaatccttcaccagatcgtgaccaggagggcaatggccaggcctcggcctcagccccctgcctggcctgcactggcacagagcaggggaggtgcaggccgaccttgaaggcgcaggagtggagggggagcccttaactgggccccggaccctgccctccatcccttagggtgtggctccagccctcgggtacccacagccgctgtcccatcctctgtgcccaggggctcccatcaacagaaaagggaagcatctttgggggtttctggacagtcccctggagacggccctgccgggaggttggggtgtggggctgaccctgtggggatccatggagacccaggtcggggctgtgtggagggcctcacggagggcagtggggtgatgcggtgctggactcttgggggcctggggctcctcagctgttgcagagtgatggggggaggcccagcctgggggtgagggtctgtgttttgtgcccgtgacactgaccagtctcagcctcagtttccccatctgccccggggggaggtgtgcccagaatgccctctaaatcccctgcctgaagccgggtgtggtggctcacgcctgtaatcccagcaccttgggaggctgaggtgggtggatcacgagatcaggagttctaacccagcctggccaagatggtgaaaccccgtctatactaaaaatacaaaaattagccaggcgcagttataggcgcctgtaatcccagctactcaggcagctgaggcaggagaatcgcttgaacccgggaggcggaggttgcagtgagccgagatggtgccactgcactctagtctgggtgacagagcgagactccgtctcaaaataaataaataaataaataaataaataaataaataaataaatccgcggcctggcccctggccctgagttcgtggggagggcatcgcccagtgggatcctggggtctctgggctcaggccctggctgtgacaggagtggggaggggccctgtgtccctgggcccaggtcatgggggtgtagggaggagaggccgtgggccaccagggaccattgtgtctggggagtccccttgacaggaggcgcggggctggggggtgctcacctgcctctctctccctgttggttctggtgggccctgggatgggggcggtgatatcctgtgggcaaccgggtcggtggggaccgctgggggctggagagggccccgtctcccgcctccttgggctgcctcattccctccctgatgaccctggtttgctgcacaaggcctggcggtgctggtgctgggacagcccacactgaatggattgaatggatgaaggagtgagtgctgtacttagccgggggcgctaggcgctgcgtcgggagcctgggacatttcctcctgctgcctgggaggtaacaccctggactgctggagtctgcattccaggagagcgggcagaccacagaaaagggagaaaaggggtggagggtcaaggcgggcggacacagggaacagggagcggggacagggcttactcagcaatcagagaagacctcacggaggaggtgaggtgtttaggtggttggtgaaggcggaagccccaggaatgggttagtgcccttaaaaaagagacctagaaggctccctcaccccgaccactgtgtcaagacacaatgaggagccatctaggaaccaggaagagaccctcaccagaccccgaatctaccggcaccttgatcttggacctccagcctccagaaatgtgagaaataaattcctgttcttttattttttgagatggagtctcgctcacttgcccaggctggaatgcagtggtgggatctcagctcactgcaacctctgcctcctgggttctagcgattctcctgcctcagcctcccgagtagctgggattacaggcacccgccaccatgcccacctagtttttgtatttttagtagaggccggttttcaccctgttggccaggctggtctcaaacttctgacttcaaatgatctgcccgcttcggcctcccaaagtgtggggattacaggcgtgagccacctcgccctgccgaatttctgttcttgttaagccacccagtctatggtagtttttatttttatagcaacttgaatagaacaagataacctcccacattcaacagctactgagtggacaagcttaaattaaacaactgttttcaaagatgtggcaccgggcggcccaggacagcggtgccgctgaaatactctcagggccctgcgctgctggctgcctcccacttctctcccctctccctctgccgtcctgtcttctttgcccagcctctccttatttctctcctcttccttccttccccccacctccccatagccgggcttggacaagtcagacagacctctgaggtctcatcccggagctgccactaacccagcctcccccgggacctgccctcacctcccagagccctgggagccagggacactccctggggctgagtgagtaccgggggctgcacctgccactcccatgtcctcggccccactcccgcggatgcagcaggtggctggtgaccgaggccagacctgggagcagcagctcccgctgggtgtgatttctctcagggagcctcatcgtcaacatcattgatttctccacacttggcctaatctcatgcatgaaaagaagaaaatcaaggggtgagcacacagcggccccatgagggctcgtgtccccagccgtcgtctcttggagctctgtccccccaaacctgggaggtggccccagagcttttccaggatccatggctcctcccaggaggaggagctacaggttggggcaggtgggcttcctgctgtgcctggagcccagatgtcaggtggcctccctgggggaagggaagttggggcccctgaccagggagccctctgccacccctgcccgctcactccatggccccatgctcccacctgcccccgggactgtgggcagaagggcaggctgtgcttggctcccatctagcactggggggcagccaggtctatggggtcagcctctgaaaaggtaccctggcaatgaccctggacggtggtcaggagccggtccatgcacagggaggcccgtggtccctggagaccacgcctccagttggggagagggtgacacggggtggggcagccagaagtgctgctttctaggggcccagggctccacctggcctgcatgggcctctccacaccccaggacgctaagccaaagcttccacaggacaaggggtggcaggagaggagttggggtgggtggctcagcctgggggctctgctggaggcaggtgacaaggaaaggagagggggtagggcggggtggagcgggcatgctcggaggggctatgtggcctccatcctcatggcatggctgcagggtcattcccctcaccgcttctaacttcagatgtggggaaaggggcctcatcccgaccattaaatgaatgtgtggctcagaggcctggtgaagcccctgccagcgggacctgggcctggcgggttcccggagcaggtggagagggctgggcacagcaggcgtcactgatactggggtttctcggtggacacagctgggaagtgtaggtcagatgtagatctggggtttttactgggcaaatctgacaccatttgagcatcagaatccacagcaatagcctcggacggagccacagaggtcagaagagcccactgagagctcagctgttgggatatgaaggggcggccagggctcctctctgggtggagtgaacccccaggcatgacgggaggagggcaggggtcccccgaacagcccagcagccatcctggaactccttgttcagcaagaaacaccgggaggtgacagtttgaggagaaacaagatatttacatcctcccacagcatctccccaaatacactgtttcatgacaaatagaaaacaggagccgaattcaaatccaatttagaaaatcacttccgatgtggtatccactaaacaccacactgcagccaacccagtccagccttggctgtgaggcagtgcccggggcctgtcctgctgaggccacaagagtcagacgcgcagacagctggggtctgaagggccctctgggctggcccaggagggctgggtgtgtggtctgtgagcgaggggcaactggcgctcctcctcaggactctggggagctcaggccacagcagaacagaggccccaggccctcactggcccatgggaatggcacgtggcgtccccagctctaccccagcaggggccccacctctccctccactggaggagacggaagccagcccagggcggagcccccaagcctccgggctccggtggttccgccaggtggacagcctctttcagcagccgtcgctccaggtatctctggcgtcggggtgcagagtctgtgggtcagtggtttgggctcctccccgtgaatgagggtattgtctcctccacggccaccgtggtgacgtccggaggggcctgcagggcctcaatgactgtggcctcaccttctgcctcctgtcttttccgctgtgagcacacgaatcgtggagaccctgcctgctcaggcccccctgggactccaggttctcgggttcattttactgctttcagtttgagggggtgggttctttcctgagctaccgtggctgtacttgaaagactcaggaccctcagagaactgggagcccccaccatgtacaccagaaacaccagccccagcggggagaggggaggtgggaaggtggaggggggagggagagggggaggaggatcaatacctggacggagacgatcaccttgactacatcacctgcaatacacagacacacaggtcagggaggggcagtgtctgatcaggggacacaggctcatggcaatggtctcacagcggtggcggaggcacaactcctgcttctccctgggagaccgtccccaagggactgaccctctctgagagcagaggaggccaactgtgttgggactgctagcccagcctgtccccaggaggcccagcatgggtgataggactgggggcgcccggcccacctccccagctgaggcccccaagtgcataactaaccctaattcaaccgtcatctatgggaggggaacaagcgcttcacagtggagaggccctgcccaccataccagcaggtgcccagttgggtgagactaagctgctgcccggcctaccctagagcctgaggccccgagacctccccgcattggaggccccgggtgaggatcaggtggctttgctgccgcctggctggaggatggggctgactttcccttcagacctcaatgcttagaagctgcgtccccgggggctgtgcacagggctcccagggccacagccgggtccacacagcggggtcagtgcccaggaggccaggcacaggaggccaggcacagcacaggtgcccagaccagggcggataggtggatgaatgaatgaatgaatgaatggccttactctcctcaatgaggacaaagccttgtccccagcagggcggctgttgaccctcagcccagagcttctcccagctgagcagggcctgtcctgctccccacatcccacagggggcaggcaggagcacagggtcatagagtgcgtgggcaggggtggctgagggctccacggtcaggggtcccaccttcccttcccccagggaggccagctgacacctgggctctggccacagcagaaagcccacctgccccagcctgcagtggctgccctgggaggagccgcggatcctggaaaagctctggggccacctcccaggcttggggtgacagagctccaagaggtgacggctggggacatgagccctgatggggccgccgtgtgctcaccccttggctttcttcttttcacacatatgattaggccaactgtggagcaaacaatgacgatgacgaggctccctgagagaaaccaccatacccagtgggagctgctggtcccagctccggccttcgtcaccagccagctgcacctgcgggagtggggccgaggacgtgggagaggcaggtgcagcgcccagtgttcactcagcctcagggagcctccctggctcccagggccccaggcagtgaagacaggtcccagggaggctgggctggtggcagctccaggatgagacctcagaggtctgtctgacttttccaagctcggctatggggaggtggagagaaggaaggaggagaagagaaacaaggagagactgggcaaaggagacaggacggcagagggagaggggagagaagcgggaggcagccagcagtgcagagaccccagagcacgggagaccagtggcagacaaggacagaaggtagagggagagccagtgtcgggacaaaaatggttagagctggagatggacaggactgagctggggccagaggacgaggagggcagagcaggatggaaggccccaccgccccctccctggggcagccatccctgctccatcccaggctccgctgggggaccccagctcctcccaagaagctctgaagtctcaggtcagttaggggcccagggtcagcatttgaaggtgtcctcccgaaggtggacaaagagcagagtgttcactttccccaacccctgaagcccaggggccctcccatggccctgacattcagggacacccacagccccaggggacaggggatctggaggcagcctccctctgggcctgcttctgggaaggcccatcctgagcctccaggaagctcagatctgatgaggctttgtctgggcccatggaaggggttatctggggcacacaggcttcagccctgcagctctcctggacgcaggcatgtgaccagggtgccgctcagggtgggaccttcaagcctttctgctggagaagacggtcatctcccagggaagcaacgtggagccccctccccagggcacagagctgggcctcccccgggttcacttacttggtctggtgctgacattcctccagggtcccattgggagagaaggtccccggggggcagttctgacacagggtgtcctgactctcggtgcctgagaagagagggacggacagagggggctgagggcaccaggccaggagggggctggcggctagggactgcttgtctgtgagcttctagacctgggtgctctacgggtgatgggaggaccagcggggaggggcaggctccctgtccagagtcttggaggtggggcctggggtggtggctctggctgtcccggccttgagtagctgggatctcatgagtccgggagtccctctgtgtccacatcctgcagtgctgcgggggctgcccggccagatgcaggccagggctggacacttactcctcctagacttagcttgaacagtggcattaaccatggtcactcccataaacccaggctccagaccaggggcccgagagcgaggcctggggactgggaagtcccagaaccccgaggtggagcaacctggggtggcccttccttgccccttcccctgcctccatcacctgttccccactgggctgcttccaggacagggctgaagtgggtgggcctggggctggccaaggttctgtctcaccagggcccctgggcaggccatgccgtcgaggaaacctggggctccagacagcggggcactggggaccagggtggaaatgggaggggtgtccgccacccaccgcttacctcccttctgcaccctctggcccgggctggaggtggcgtaagcgcggcacgcggcgcagtggtccccgtcctggacgatgcagaagtggcctgggctgcagccacacacggcgttctctgtcctggagcagttccggctcgcgcgcaggcccatggctggagtccaagaggaggggctgagaggggtacgtggaggccgggacaccatccacgggccaggacagcatccacaggccaaggactgctgccagggcgccctgccaggctgaacccctggctcagccaaacgaggtgcccagaggtacccagcatggaggacctgaggccgggagggacaccaagggacggcagagctgcgtgtgggacgagggcttgcaggaaggtcctgggagggcttcgttgatgggagaaaccagccttctgcccagatgggcaggacgccgagcttgcactgtcagttccagggcagggtcccgcaggcaggtcctcgccccacgtgcccacccagacacccaccccgcaaacgggtttcccatctgtgcaaaccaggccattccaatggcagaggcaggtagggtgagagccccacttcttcaggtactggtggaggtggggtacaagctgggcctgggcccctcctgagggcagcctcacctgccacctgtgcccccacatcctcagcccaagtagacaggtgctttcacaagaggggaggggcatggaactgggcatgcaggttgaggtgtgagccccaaatcccagcctacatgcatgaacccccaaagcactccagcttcctcttctgttcatggctagcccacctgccctgtgcctccctgtaggctcaggccctgcccccaggtgtgccgtcagccctgtcccgcaggtgcagtcctgcctggccgcagggagcactggccatgctgagcctggcatgaggctccaaggggacagagccgttggccgcatggacaggctctgcgctcagtgactcaaaggccacctctgggtctggttcccctttctgtctgcctggactcaggtgggcaccagcctccaggtgacctcttcccctgaggtcacagggggaaccaatatctggaggagaaagggacaagaagccctgtggggaagcagcaggcccgagtgccggccggagagtcccagcaccatcccattccactttgcagctagggacgtgggcacaggagaggtctgggcacccaccccgggcaccagaggagccaaggacgagggataagggtcagtcgccaagctcaggatggcccacctggcggtgacaaagtgagaggtgagacagaggtggacgggggccggaggctgacctcaaggcgtcccctgcagggtgcatccatggagatggggttgggacctggcctggggcagccggggccttcctggggcactgtggccatggagagagggtgcagggtgcgggggcatccaggctgcccaagcggaggctgggccggctgtgctggcctcttacctgggtcacacatttggcactgcagacacttgcttaggccattgaggtgggcaatgtaggtgcctggagggcagggttcacacactgtgcccgtcagctccccgcaggcctccttcacacgataacctgccgcccagagagtgggaacttcgcaagtctgcgggaggccccttcgggagcccacccatcactccacccgcgcccagagcccaagcagggagacaccagctaaggggactcaaatggcccatgagccccacgggacacagcagccccatcagccatgagcagagctgctctggggaaaatcggaaagttctggaagcacatggggcctcctgggacacctggcccggctctggtatgtgcccccgagcccatgtctctggccacggtgggccagccacgtctctcagacccaccccctgtgcagtgtgactgtgagggtcccccagggtgaagagtccaagctgctggcctgggggttctgccctcactgtctgcacacctagccccagggcttcatcacacccatggctgtgggggcagagaacacaggggtgtctggggcagaagggggcaagagtgtctgccctcggcccacagagctggcccgccaaagggctgcacctacctggactgcacttggggcagcactcggagcccactgggtactcgtcctccttgcaggacggcagagctggggcgtagcagggggctcccaggaaggtgagatacagcacctaagggggtcaggacaggcattgggagatgccctggctgccctgtgggctctgccaggcttggccccacagcctgaatctccctctgtgcaatggggaggagcggcagtgcctggtagagaggacagaagcgggccccaggccaggctcatggaacaaccttgccgaccgctggagcccgggatagggtggggaccgcccctcctccagccctgatgacgctgcctggcagcgcggagccctgggaactggaactctgccctcgccagggaccccacaccccacacctgggagcattgagcccactgggcagacaacctgccggcccccctgctggcctaggttggacctgctgacccctgaagagccagcaggggcagccagggatgggccccagaggctcacaagccagacagtgggtgacaggctgatcagggccacatcggggagggtggctctgccgtggcctcgttcctgggctggctgatgggcagtcgggggcccctgatggggatagtggctggacaggcaggagtgccacatgagcatggagagtatccccaccccacccacctgggtccagccccctgctgcacactgatcttatcacctgtcaccaaggtcagggctgccggggagttgggtcacctgctcgagggccccgcccagagacgcccagagacacccagcccccagaagtgcccacatccggccaaatgggggctcaccagctgcccgtggacggagtggtgagtgggggacacacgcaggaggaggtctgctgggtagggctgtggctctgctgctcaccccactgtggtgagcccagtgctgggggtctgggttgacccgagagccccaggcagcaggggacgggctggacgccggagccagcaacggccaggacaggggcatggggaagagatctgtgggaggccctggggtcagaactgggatctgcgagcagacggagaggaggctcgggggctcaccagcctcaagacgtcggttttgggggtggatctccagggaggaggcccccagtctccaggaggctccatgcctcaggctcagaccggcagctcgggaacccagctagcaggatgaactccagcagaggaactcagcgccattgctgcggctgtgggccagaagagaaagagaaagagaaagagaatccgcctcggtgtgacaagctgtgcctcagaacccgagcagcaggagagtgggcagcagggggtgtctggcagcagagaggggctcaggcctgctgggtggagcggcgctgggggacacaggtgggccctgcgggaggcaggagctgtccaggcaaagccgaggggaagggccggtatgaaggaggcgcccgatgggaggggcgagttctccccctgcaccattccagtccactccgggtttcctgtagaagggggagccccccaaagtccatctgtgtttccccacctcactcacacactcagggaccctcggctgctccccggggcgctgactgacatttttgccgaataaaggggccctgtgggtttcctgttcccatctcagcttctgctgaacagggtaaacttcccttccgaataaaaccaccagaatgcggtctggccaatttcagtcatagacccaccaggcctgtgtccctgcgtgagggggtgggaaaagcccagagtgcccctacccgtcccctgggaggggtggaagggcagctcttgctccccctgcagagacgctgcgcggactgggaaggctgccagcctcgcccggtctccctgtggaccctgccctgaccccaccccagcttcctggctccctgcaccccactgggcttccctgccccacagagcctggtggtagggagacctccggatggagacagcccacagtcccggagccccaaggcaggcaccagtgagtccctcgtgacggcctcgctccctgcatcacatggaacctcgtgacccacgtgacgacgccagtgcccccgtggccccttcctgctgctggacgtgatgcagtcaatggaagcccaggtctgtcacgcaccgcctgtgcttgcccagagcaggtcccagtcaccccctctggcaccgcctgctgcacaccaggaacccccacctccagcaagcccatctgccagacgcctggcccaggaccgccccctgcccctcgactgccccctgcccctcctggtcctgacttcagccaggtgaccccctccagggtccagccctggcccctgggggactcagtggcatctggtggaaaggaccttggggattgcgcccaccctcacctgcaggagagttggcagggtggccagccacaggaatctgtggcaggagcccggggacctgcaccccaactagaaagtgtgcagccctgcaggccggccctggagagggagcaggcaggggtgaagttaggccggctgtggtgtgcgacaccgtcctgtggggccaagcgtcccgagctccagaggcaggtgcactcctggccagcatccagggtggacgagcccagaccccaatactctgaggcagggtgggggaccaggtggcacccagtggaggaaaagcccccaagagacacgcaggagcatggactcccaccccacagctggagcctgggagaggagccccatctgctgtttccctggtgcactcacatcctggccctcagcgccccctgccaggaatgtcccccacatgcagagccatgtgggtcttgcaaggaagaagaagggggccccttgcatcctccactcccgggggccccaggagggcatgggggctccagggtgcagggacagcacgttccctcaccaactccccaagaacgcccaacctccaagagcagacacagcgcctacacctgccggtacggggctccaaccccactctctcagatacgtcctccagagtcgtctcatccaccccaccctggggaggagggaaactgaggcatggcaagagacaagactaacacaggcatcagtgagactcagcccctcctgccccttcctccatgcccctcctaccccgacttcagctcccacaccaaggccccaagcctgacatagggccccaggtgccaggcctcaagggggctgaagggagcccatctgccccaccgagggcacagacagtgccaggtctttgctgaaatgtcacctcttccttgaggccttctctgattgctgagtaagccctgtccccgctccctgctccccgtatccgcccgcctcggccctccgtcccttttctcccttctctgtggcctgcccgctctcacagaatgcagactccaggggtccagggtgttacctcccgggcagcaggaggaaatgtcctgggctccccacccagcgctcagcgccccccgctaagtacagcactcactccttcatccattcagcgtgggctctcccggcaccagcaccgccaggccctgtgcaggaccccagggtcatcaggaaggaaatgaggcagcccaaggaggcgggagacggggccctacccagcacccagccatctgcattgacacggctgcccgcaggatatcactgcccccatcccggggcccaccattaccagcagggagagggaggcaggtgagcaccccgagccccacgcctcctgtcgcggggactccccagacccaatgctgtgccagtgcaggccaggcagggggctgaggccgaggcctggtcattgccatcctggtcacgatctggtgaaggatttgagtccagaagccaaacgtctacagtcgtgtggtgcggacactcaggatggactgcccaggccatggggggctctgagggatgaagaggaaactgcgggggcgaggtgggctgcgcgtctctgagaaagtgtgtgagttgagtgctgctgcagagggaagctggggtccaccgctggtgagcggggaggggacgggacacagaaccggccgtggcccaccccgagacggaggcgcagacaccaggcccgttctgtgctctggaggctttgggcagctgtcaggctagtggacggtgtgcagagcagatggaggcgtgaggaggcggctccggggtcacctaggtgggcagccctcacaggggaggccgagggggagggcaggagggcggagcaggcggcggtgcaggaggcccgtggaacttggagggctctgtgtccagctctcatggcccagggcgggggcagctccaaggcctcgggcttggggacagaagggagaggacttgggggttgggggtggtcagagcattgtgggagggatctggggcagctggggcttcccagagggtgaggtgtctgctgggaattggggcagccccaggcgtccccaggcctccagcccagccccggttcctccccgctgcaggccagggtatcaattgcctgctgggaaacctcagggtgcctctgtctcaagtgcctgcccctgacactcctggccctgggctccccccgcctccccgtccgtctgctttccccacctcctcccctcccctggccgtctttctgcctcggggatggcgtcacctctcaccccaaatcaggaccctgggccccagctctgttccccacctcaccttccttgtgaccaactcctgacctcccatgggcttggggtgtctgtggccggaacattcctcagaccctctcctccagccccactctgtcccaccacccgggcatcccccacctgggttccagccctccaaggggccccacgctctgtgtccatgatcaggacactcacacgcacccagctcgcgcccttccttccagacattcgagctctggaagctcacagtcaccctagcttagtgcacagccacaggccaggcaccttcaacatccccaccttccaggtgaggaaaccgaggcaccgagagctgggggccaggccagggggtctccctggggggagcagaggagtgtcggacctcagaagaggctctgggggtctgagccgccactgggcgctgccttccaggttcagcagggacagagctcagggggaaggcacctcccgtcttggttcaatacatggacccctgaccctgggaaagggactgagccaggggaggcctcaggtcactgcaccatgaagttgtggggagctgcgggggcctctgggctccgagctgggcaggcacagcgtggggaccacgtgctgaggggaagaagcgtgccagggtggatgtctcagtgcacacacaggaacgtgaaatggctgagccggcccagagaggcagcggagcgtgtgcggggtggccggcggagaagcagcaggatcccaggcgggagggcacggccttctgagaggcaggttgcaggacaatactcagtgttttgatccaggaggtcctattagggcgtttcattgataaacgcacatttgaggtggagggtggccagtgtagaatgtgcctggcagctttcacagcaaaggagaattctagaaccaaccgaagtgcccctctgaagggagctggtcccgtccgttccagccgccgtggagtaacacagccagcagtttccctcctgccacgaaagctcgagactgaaactcaggatgaactgttttcagcccgggtcaccccagccctggggtggaggcccattgaggatggccgagcaggggcgggcatccaggcaggtccagcagtcctggcgggctgaggagaaggaggtcagggctcagggaggcatccgcagagggacctggcaggcagagctccggaaaggagggaactgcacagacagaaagctccagaaggctgcctgagggtctctgaggcctccggagtcgggcgccatgcatgtggaaggtggactttcagcatgggtgggaccctagggggctgtggacccccggcccctgggactcacaggtgggagacaggagttccgaccgccagggggagagtcctggaggatcctgggctgtcggcagccacccagcagggcccgtcctgggagtggggctggactcttcctgcaggaaaggctgggctggacctgctctaagaggcttcagaaccagccacacgaagaccaaagtgaagagcaaggagctgaactccacgcagaacacagcgcagcgtcctttaaaggaaggcccaaaacaacccaacaaaaatgccaggtgatcaaagccgtcacagcacaatgtccacatccaatgagaaattgctgctacgtccagatgcagggaagagtaaccatgggaatgtgggtcagtagcaacaggcccagaagggcagccacagtggaattgtcaggcgtggaccctgaaatgacaatcacaacgtcctctaaaggaaaatgtaagcctggtgtgagaaacggaggacaaaacaaagagccaggtctgaaatgaataacgtccttgtaggcacaccagtccccctgggcggctgtcacaggacgccgcggtctagctggcttccccgacggaaatgctgtctcaggcctggaggctggaagctggcgtgagggtggcagcaggtttcgctccctgggagctcggctgtggtctgcagatggcatctttccgtgtgtcctcacgcagtcgcttctctgtgtgtgcacttccctgacgtgtctctgtccaaacttcctcgtctgaggaggactccagtcattctggatcagggcccacccatatggcctcattcagccagtcacctctttacagtccaatctcttcatcccatcccattcttagcgtgaattctggagggatcctgttcagccaataacagtaggattaggccaggtgtggtggctcacacctgtaatcccagcactttgggagactgaggcaagaggatctgcccaggagttccagaccagcctgtgcacaggcaaaacctcatctctccaaaaaagacaaaaattagccaggcctggtggcgcacacctggagtcccacttacttgggaggctgaggagggaggatcagttgagcccgtgagccccggaggtcacggctgcagagagccatgatcacaccactgcactccagcctggccgacagaggaggccctgcctcaaaacaaaaacaaaaacaggaggattaacaacagattagacagctcaaaaggaaacaccagtgaacttgaagatatactatcagaatctaccccaaatgaaaaacacacagaaaatgaataaatgaacgtattctcaaagatctcctggaaaatatcgagctgcctaacagaagtgcagttagagtctcagagaaacagaaagaggcaggaacagaaaatcatttgaagaaaaagcagtgaaagttttctaaactacaagaaaactgtgatcccacaaatgcagaaagctcaacagaccccaagaggggtaaatagagaggcatgcactgcacagcaaatcctaatcaatgcccaggaaccagggacacagaggggacctggacaccggggtcaggtgaggccacctttgggtacaaagacgcaaagataagggccgtgcggacttgtccccaggaacagttcaggtcagaaggtgagcaaaacatttttacaatgctgaaagaacatttcacctttgaactccaaacccagtgaatctgtctgtcaaaaatagaccacgctcggtggcctccgcctgtggacccagcaactcggaggccgaggcaggaggatcacttgagccccaggattcaaggccagctctggcaacagagcaagaccttgtctattaagctacaaaaataaatgaactggaggctgggcccagtctaggggactgaggcgggcggataacttgaagtcaggagtttgagatcagcctggccaacatggtgaaatcccatctcagctaaaaatacaaaaattatccaggcatggtggcacatgcctatagtcccagctactctggaggctgaggcatgagaatcgcttgaacctgggatgcaggggttgcagtgagccaagctcccaccactgcactccagcctgggtgacagagtgagaccctatctcaaatatatatatgaaagcaaatcaaagactgaggacatactgacagctgagagaatttctcagcagcagacagatttgcatgacaagaaacatccaaggactttcttcaagcacaaggaagttttttcatagggaaattgtttctttttttttttttgagatggagtctcactctttctccaagctggagtgcagtggtgccatcttggctcactgcaacgtctgcctcctgggttcaagggattctcctccgtcagcctcccatgtagctgtgattacaggtgtgcaccaccatgcctggctaatttttgtatttttagtagagatggggtttcaccatgttggccaggctggtctcgaattcctgacctcaggtgatccgcccaccttggccttccagagtgctgggattacaggcgtgagccaccttgcctggcctcatgtggaaattgaaatctgctcaaaggaattatggatgaaagaaatggcaaatgtgggaggaaatttttttctcatttttaaatatcttcaaaaataataaaatgcttaacgcaaatatgttagtgatgcattgtgacatttaaagcatatacaattaaaacctatgacagtagtataagttatgaaagggaaaggcaagtgtgtgctggtgagattcttctgcatttcccgctgcgtgggaaggtgcaggcatgtttagtggtcacacaacctgaatataggctgtgataagtgcagatggatgtcacaaacccttcaataaccactaaataaggaaaacaaagatgtatcactaagaaggcaaccatggggatgaaatgaaatactacagaaataatcaaacagaaggtaggacaacgggaaatcagaaatatgaaacagcaaataatagaaagatggtgtgcccacatccagctgtataggtaatgactttgaatataaatggcctaaatagtccaattaaatacagaaatggccatatcagatacaaaaccaacagccaactaaaggctgactacaagaaacccactttacattttaagaaatgggctggttaagccaggtgcggtggctcatgcctgtaatcccagcacttagggaggcagaggtgggaggacagcttgagcccaggagttcaagacctgcctgggcaatatagagagaccctcttctgcagaaaaaggggaaaaaaagacacacacacacaaaagagaaatgggctgggtaaaagcaaaaggattgcagctggaaattacaagacagagctgcagagaccagggagtggtgcagaagctgagcccaggagatggcatgcagagtcgccccatgcctcaagtctgcaggtgagacaggatgtgtctttctaaaggtcaggagccaggcaaggactcccatcctaccacctgcactcaacatggtactggaggtcctagccagtgcaataagacaagaaaaagaaatggaaggcatagagattggacacaaagggggaaaaagacattgcctctttgcagagaatgtgctcatgtgtataaaagtcctaagaaatcgacaaaatgcctgtgagaactagtcactttattatcaaggtcacaagatgcaaggccaatattttaaaaactaaacattggaatttgaagtataagggaaacaagaacatatttgcatcaaaaaacaggaaatgcttaggggaaatttaacaaaatacccgcaaggccagtgaaaacgttgtcgagagaagtgaaagaagttctaataactggaaaggcatggcatgtggatacatcagaagaccaagtatgaggaaaatacccattgtcccccaaatggaccaatgcaatcccagtcaacattccagcaggcttggtcgtcgaaatcgagaaactgattctaaacatgtatatgaaaacagacaggacatttaccagccgaaataatagtgaaaaggaagagcgaagttggagtattttcatttcctgacttaaagacttactgtagagcttcagccattgagagagagtggggcgggcatgaggcgtgccaataggtcaatgaaacaggagcggccagagagagacccattcacagatgatgcaagcatttctgacagaggtgtcaaggtaatgcaatgtgaagaaggtagtctttttggcaaacaatttctggaatactggataaatgacaggggacaatggccttaatctttacctacacgacacaaaaaattagcttgaaacgaacgataggcttgaatgtaaagctcaaactataagacttcctgcgaaaaacattggagaaaatatctgtgacctggacgtgggcaaagatttcttagacaggacgcagaacacaagagctacgagagaaaatgtttgaaattgggacttattgacattagcaactcctgctcttggaagtatgctttccaggaaatgaaaaggcaaaccacgcattgggtgacaattccaacactctgagaaaattcttacaagtcaatacgaggacaaacagcactattgttttttaatgggcaagatttgaacttcaccaaagccatgaaagggtggtcagcatgcacagtcattcgggaaatgacgttaaaccactgtgagattccactccacacccgtcacggtgatggagaggaaaagttctgaccataccaagtgtgggaaggacatggggtaattagagctcccacgtgctgctggcaggagcctgaaatggtacagctttggacatcggtttggcaaattcttttagagagaaacacacaccttccctaggacccagcaactccactcctagtaaccaagtgaaatggaaggagttgtcctcagcaaaacgtgtgtgcgaaagttcacagtcactttctcggtgataaccaagagctggaaaccactgcaacacccaccagcaggtgaacggattaacacactgggctagggccacacaatgagatgctacgtggcaacacaaaatgaaccgtggacacacactgcacggcggatgaatatgcagacatcaggccacgtgaagggagccaggccccgaggcgccacgctttgtgattcaggtgaaattctgggacaggcagatctaacctgctgggagagagaggtcaaggatgatgtggccagggctggggaggggttgggaaggggctcatgttgctggggtgtcaaaacaaagcaaagggccacagacttgggggctcaagaaatggaaacgcaatgttgtcatggttctgggggctggaagtccaagatgcaggggcaggtggggttggttccctcctgggcctgcagatggtacctgctcc

SEQ ID NO: 479 - DNA, 100038 bp, Homo sapiens
ccccttcaatcttcagaagcaagcactgctcttattttttcttcaccacagatttgttttgcctgttctagaactttatagaaatgaagtcatgtcgtatgtagtcagttctgtctggctccttccgttcagtgtgttttgtgctatattcatgtcatttgtgacgtgctgaggattcatttctttttgttagtgagtagtattccattttaagaagatataatttgtttttacattctcctcttaatgggctgtttctgggttttggctatgattcataaaactggtgtgaacaaatatttttgtggacataaattttcctttatcttgagtaaatatcggattgaaatggttgggtctggggtaggtgtattttcggttttataagagacttccaggcccttttccagatggttgcaccactttacatccaccagcaatgcttgtgcgttccagttgctccacagcagcaccactaaagtctttttaaaatgttagcgattcccgagtgcagcatgtataaccttccaaaaaattcaacatcatcttccgctgtgtttccatccatctgaagcctgttagaatttatccaaatccaaatcagtaaacccagagtcagttctccaaaaattgtgtggaaaatctaaaatttatctttactactgctggctgccccctcttggcacttctgtgctcttaggcaccaggaatttggtaacctggtttctcatctcttccattgttttgttttgttggagagagagtctcactctgtcacccaggctggagtgcagtggtgccatcatagctcactgcagcctcaacctcctgggctcaggtgatccgtccacctcagcttctcaagtagctgggacttcaggtgcacgccaccgcactcaactaattaattttttttttttttttgtatttttttctacagatgaggtttcatcatgttccccaggctggtctcatactcctgagttcaagcaatccacctgccttggccacccaaagtgctgggattacaggtgtgagctactgcgtctagccctcttccatcgttttcaaggagggatcaggggtcagctgttcgcaacttggtacgaatgagtttgtcattggatcacctcccttgggaggaagtcttgccctggggatgtaggaacaagaactaacatgctcagtgcctcctaacagccccactttacctagtgtgtcaattccccacagacaagtaaactgaggcccaggaagcatcgttgcctgaggttgccgagttgataagcaaaggtctcagtccctgtggactcagagcctgggcttctcccctgggaccctgcagctccaccggcagttattccaattcttcctcaggtgttggaggcttgtatggaaactccttgcttctgtctctcgctcagcccttagaaaacctccaagagatggccactcctgcctgtggtgcagagaacgcccaggcagaagacccttggaggctcagacagagaactcactgcactttcagtcatcctgggctggctccccggcccctctcacgttctttatggatttgacccaaagtcttccagatggatggagctgtgggcactgagtctgggaatgtctcagcccaccttggctcccttctccagcaggagtggaggtgtgtgatgtcaaacaggcccagcctctctctcagacccggttctgggcccacacagccccttcttcctgaaagcagaggtggcagtaagaggatggctttggcctttgaatgttctcaagcgatccaagttcagagtatactgttgctgtcctctgtccctgaagcttctctcctactccttggacaaactcacttctcccctcagggacttctctcatgtagcagagtgtacacctgctgccccagcaaggccttcacaatgatccaagcctggcctgttgctccagcttctggaacctcccatggccttcggtctacttgaatgctcctgaggccaggtagctcatcactgccggaggacctgttgccactcacttctagccacaagaaatgtctgcctgtcctgagcaaaacccaccttggaggaacttctttactcccttgttgaatttttggctctaccaaataaacatgaattgcttccctgtgaaagacctccaaacactttcctctgcctgtgtgttgttcatcagtggtgtagccgaatccagggcgaggaggacctgcattttagctggtgttaaccagagtggagggaggattaggagtggcctttgggtggacaggaggtatgacaggctgcagatggtggagcaagccttgctgtgcccccgacccagctcgacatgcacacgtgggtggttctggctccctgggtgggaagaatggtggggtgggtgggcattgtgagcctggcaaccagaccccacggaatagcagggaggaggaggaaggaggacgccctccaagaaacagtggagtgaaaccttagtgcctacttcacagcccatctggggtctctccctgcttgcttctgggcagagggtgtccattataccacaagcacaaccttgaaatgtgctggagcaggaagtcgcgcaggacctcattccccaggactttccatacatgaggaatgcagggctgagcaggtgagatgcggcggtgggaggcatgccgcctgctccctctcctgattcactggggttttgggctgcaggcagtcagaaggtctcattttggggggttctcagcaatagatggggatacagtaggagggcaaagtcacagaaattctctgccggaactccaagacgcaggggctgggaaccgtctgcaggacccagacccagagttggaccaggattaaaggtggtggggggtgtggggtgccgaatgtgaagaacagaacggaagtgcaggaagacagcccgacctccaggagacaccatcactctcggtgtttccctccctgtgtttctttcttccaagaaagggtatttccaagaggacagattggttgaccaaaaggccattttatttctactttataaaaatagatgaaaggagacttgaaattattttgcctcttacatcactgggtttgggttctggaagtccctggagggtgcgcctgtagcccagacttcacaggtagacatggaggtcatgcaggtcacatggctggttgacacctgtaaagctatgatggccaagcagaactttgccgggtatctctggtcctattccctcccccgggtcatctgcctccctcctggaattgattgattaagtgctgtccctccatttcgtctaatagaccacgggaaggataggccaaacaagaagggcctacttcaacttacaagtcaagtcacggtttcagaacaccttatctccaacctctgtcctcaccacaagccagcccgacaatgtcctcatccgattttctcaaaagagtttgggcgatcttgagggcaaatcccattaaatatctgtacccagtctagcatccagagttgtcagcgttcgtgagcaaacagatctcagaggcatcagtgttcgtgagcaaacagatctcagaggcgtcagcattcgtgagcaaacagatctcattcttagtgagagtgcttctcctctggaagctcttgaggagacaccctccttacatcttccagctgcaggtgttaccggcaaaccgtggtgcgccttggctcacagccacatctctccaacctctgcctcctcggagtccttttctgtcacttagaaggacgctgtccctggattcggggcaatgctagggcaggatgatctcatctctgaccttacatctgcaacagccctttccaaataaggtcccatcctaagattctgggtggacatgaattttgaggagacaccattcgaacatatctttgtatctcttccttctcagggtgtgtcctaccccctcacagcttattctttttcccttcaaacactctgttgagacccttacacgaggcggtttccccagacaccgcacagatctctcctccctaacgagttccgcagactctctggaagtctggctggaaatgctgctctccctttttccttctgggatggaaaaacgctcccaatggctccaccagtcagtcagtgagacgttccaaaccggtctttccacttgggcttcctcatctgtttatcttttatttatacaagcctcaaaccactgaacactgcttggtaaacattccctcatttactatgcaaatgttagcacgggggcccacgcccgcccttccccaggaaagccactgagtgctgaatgcggatggactttcttcacattctttggggttttcggaaagggtatgtttttcctaacgtcacttcaaatgtatttcttaacaaaaacctcctaacctttggaaaatggaaaagaagttactcatctgaaaggaaactccaagtttttaggacctctaccaaacccctgagtgactgcggtcacctcgcctgccagcatgctaagaaggcattgtcttgccacagggctgggtttctgccagcgatttctgcaacatgttatgtctgggttatgtatttgaattcccggccaggattttctggtgggtctccctaccctccatgaaagagtccctgtgcagtgccagccctgcatcatggttcttgcaacgactgagcattctgcacgcctggaaatgtggagcagccgggaggatgaatggccgtcagcttctgagtccctcctcatctttacagtgcaatagtgagagtctttttctaggtcagtggtttgtaaaatggccagctttagagggaaccaccacccttctaagaattgtaactatataatcacatggcatttaaatatattaccaagaccaagggcatcagagggcatcagtttctcagctgggagtgacttcctcacactcctggattcccttggcaggaggcagatgaagagagctgctgaaaaagtgactttcctggtttgtgatctccacgggaaagaacatgcgacccgtctgagccttgaatgtcggaatgaagtgttttgctgctggtcacggctattctgggaagcacggctgtgggtctgtgagaccatagaagaggtccttaaaataatatgcacgcccgggagttgggagcgatgagcggctgtggggagccctcttctgcctgctgcttcctggtcctaccctaatgtgtatgtgggctgaccccaggccattcaacaagcacttattgagtacctactgtatgccagacatgggctgggccccaggaggaagtagtcttaggtcctgattcctccttttgtttttgttttgttttgtttttgttttcgagatagggcctggttctgctgcccaggctggagtgcagtgacctgaacaaggctcattgtagcttagacctcctgggcccaagtgatcctcctgcctcagcctcccgcatagctgggtctacaggcacacaccaccacgcctggcaaattttttcttttgtattgttttgtagagacaggggtctcactatgttgcccacgctgatctcaagctcttggtgtgaagtgatcctcctgcctcagcctcctaaagcactgggattacaggcgtgggtcaccgcgccaggccctgactcctccctttgtgctgcccatcacctatcagggcaggggagaccttcactcacattgtcacagaataaagggaccaatgacctcagagaagcgacagcgaagtgctgttttaggtgtcgggaagtgggatggcagtgggccgaggactgaagggcagcagggaggaatgagaatttgaattggcgctgagtgggatgagtgtttgaattggcactgattggaatgagtatttggattggcgctgaatgggtcaatattggttctccccttttgggttgatgctgatttgtggccctagcgtcccccaggcagggccccaattgtgttgcttgaacttggcctctgaccccaggctgacgtggaccctgggtttagctgctgctgctcgtgggtttagctgctgccgctcggctctgcttctgttgcattctggttctggtcatctgctcagtggctcagcccctctggggatggctcttgccatgtttagtcccagtgtcaggagtttctggtcctggagtcagccctgccactccctggaggaccttcccgaggccagctgcctaatccccagccccgatcccctgtctgtggccttgtgtcgttgtgatccacactgtcctgcccaccacgctgtcacctgcttgcctcaacgctggccagctactgctgaacacccttggaagccctgacctggcccaggctgagtgtcccctcccctgaccatttgtggggacagctcctccagcactggccggctctcgtcggggtccattgggggccacttctaggctagaccctcactgcctgcctgtctgtccctagagaccaccaatggcaaggagtccatctggccagtggtcccatggacagtggaccgtggacagtgacagcaggttggacagtgactgcggtggacatgacacagccctttcttgcagggaaggttgatttcagggtcactcttgcacttgatcttcctaaagaggaagcaaggaagccagcctctccaaagcgctgattgcatcctggggtctctgagcaagctggctcagttgccacctgtgggcatgcactattcttccacttgcagattagatgccaggacaagtgtcttccaaaggccacctagaaagcaaacgtcaatgaatctggggttagacctggctctgcaaggacccaaaggtcatggcagccctcttcctcctcgtcgtcctcagcggtcagcggcttctgatgtctctgttccccagtcgctgcatacttgtgcctcagagctgagcttcttatctaccctccactgacgctgcccactcgggaaggagcctcccttgctctgaagctgccactcaggtacggaggctggagggcgccataggggacagacagggtgggtaggggagtgctgcctgcctggcagattcacccaatgccagcatttctcatcacagcacctcagacaaggcagcctgacacttaacagccctcattatctgacctaaattcctgctgaaattgaggtcggcctcttctgattctgccccaagtgatctggaggcctcggtcggtcaccatgcccctgtgaggggacacaccctgtgcacggaaactgatggtgaccggggccacgttcgctggtgccctgccttgatgcccacttctagagaggcagagctctcagcacctacattgtcctgggggccgggcaggccgggacctggcgtgtggctggaagggtggagtgatagggcagtggaaatgcatcttgtgccctgtgctccggcgtccctgccctctgcatgggttcctgggtgaggccagctcccggccccagcctctccggagggcccaactgacccttctcccttcaggcttcagtgttggtgccacggaccctgttgtctgggcataattgggcgtgggattatgtttaacctacaggtgcacacctgtagtcccagctactcgggaggctgaggtgggaggattggtgcccaggaggtcgaggctgcagtgagcccagatcctgtcatgcactccagcctgagtgacagagagagaccctgtctaaagaaacaaacaaacaaaaaaaccagccaattactaaacaaacaaaaaagcagtgagggtcggacatggtggctcatgcctgtaatcccagcactttgggaggctgaggcgggaggattatgtttaacctgtttaacatcttcccctttagactctgtgtgagtcggcttgggctgggaacaaagcagtgcaaactgggagcttaaacaaccgacgttgattccctcacagttctggaggccggaaggtcaagatccaggtgtctggacagagccctcctggcctgtgctggtgtgggcggaggcggtggtccctggtgtgccctggctgcagccgcctcgctccccctccacctctgttgtctcatggtactcccttctccattcatttgcatccaaatgtctctctttttataaggacatattagatttagggcccaccctactccaatttgacctcattttaactacacctgcaaaaatcctgttcccaaatacagtcacattcaccagttcggaggggtaggacttcaacatatctttttgagggacacaatttagcccccaagagactttaaggcttttggaggccatgagcgggtcccactgaggccccaggctggcctgcagcaggcagggccggcaaatgtgtgtggaaggagtggggcagggcagaggccggctctcagataggcagctgaagaaaaacccggcacatccacggggagttcgtgctggtgtcttctctctctcttttcctctcctttcttatatgttgggttcttctcaaatgtgaattttctgtatcagcatccctcctgcctgcccataccctcctcccaccacccaagtctcacttcctgttttcggcctttcgcctgaactgcttcagaagttgaaaccccacagggctgggcctgcccctgcgaggcatgttttttttctggaaggaggaagcggcaacgggttacaggctggaggctgtccctgtgctcagatcccacacacgtccccagcaagccccagcccctgccctgcgggaagtggggtcttgaacactgccccgtggggctctctcaggggcaggtgaggcagcgtcttctcgcgccctcatttccctcaacttatctccagggcaaaatcctatgcagtggcacccagtggccggccctgactttgatcttgggtgctttcttctccacccaaaaggctctgaggtcatctctgtatcagaaaatcagcaagatctgcagcgggacagtggggactgatggccactgtcatcagcatcatggtgagcacttgagctgtggtttcctcaggacaaattggccttccccacgtgaactcgcggcaggcagagaatctaggttgggaccctggactgcacccggtgctgggctcctggccttttccctctccgccctgctaaggctgctgtgccgagccctgggaccatccaacagggagaaaggccttgggacaaaaatgacactttctcaacatcacccactgttgaggttacaagaagcagagagtgtgagaacgtttccaaatgaaagtgggggaaggatcgcaaagaagcaagttagttagggctgtgcccagccagcgccagtgccaacgccgagccgcctctgcaggggaaaccgaagcagatgtggtgagataatacatccaaccctgagtgctactctaacctgccagaggcggagggttctcagtgagatgaaagcattacagatgcgttagatctaagggaggggcctgcagatgcgcagctggcagagaaaccagggaggggctgaactgtcagtcgcgaccaccagggatctgaatcagttcaccgacagccttggggacattcaccttgggctccacaacctgtcagaaatgcccccaagcccaaaggcgtcgagagaatggccaggttgtttcagattgacacatatcctaatgtacaagtcagcccacacaccccacgtgcactgagcgtctcttgttgttcaccccaaataaactctgccggaactggggcgggactcgcaggggcggagaaggggggagacgggcagagggcagaagtggatggtgagaagagccaatggaggggccccgtgagagtgagcaaggctgcacccctaaccgacgtcctggggctactgtacaaacaaagaaccacaggctgggaggctgaacaacagacctgcactctctcgcagctcggaggctgcaggtctgaaatcgaggggctgacagcgctggtttcctctggaggctgcgagggagaaaccgtcccctgcctctcccaggctctggggtgagcccttcctggcatcccgggctcattgtagatggatcactccaatctccatggcttctcagggcttccctccatgcacctcaaatctctctctccttccttttgtaaggatgccagtcattggatttaggttcaccttaaatccaggatgatctcatctaaattacatctgcaaaaagaccctttttccaagtaagttgacattcacaggtacctggggttaggattggacatatcttttgcaggggtgcagggggctgccactgagcccgctgcacagggtgacctgggccaagggcccttcactttcacttcctcattggcaagctgccctgtgtttggactgggtcgaggctgtcaaccttgctgcccctcggagtcccccctggtgtcccccaaacagattctaagctgctttcctggggctggaggccaggcattgggattttttaaagagcttcccagcaggtgagcagcctttcatgggtatcaggagaccttcctggcaaatgtggtgaaggtccttcctcctgagcgatgccttagacccaggagcccagggaggctgctcacctgatcgttaggacaggagcagtggaaacctctggcctcagaccccctggaggaatccctccctctaagactctgggactggtgcacgcaaggagctatcgtgaacattgctcccaactggccgcttgcttgtcccccggctccccttggccccagtggcggctttgcctgaattagagggcgtgagagccacctgtgtctcagcactgcaattaaagcaggaagccctttcggaagcagccgtgtgcaccagcctcccatgggtggagcagagcaaaccacccacttctgccctctgcccttcttcccttttctcgacaccctgcggccccccagtttcagcagagtttatttggggtgaaaaacaagagatgctcagcgcctgtgggatgtgtgggctgactcgtacattaggatgtgtgtcaatctgaaataacctggccgttatatggatgccttggggcttggggggtttctggcagtctgtcgagcccgaggtgaatgtccccaaggctgctggtgaatcagatccctggcgttctccgttggcagttcagcccaacagtttctctgccggccgtgcctctgcaggtccctcctctgatctgattggattaatatttgaatcaatagactgagtcaagcagaatgtgggtgggcctcatgcaatcagctgaagccctgaaaagagcaaaagggctgccccttcccccgaggaggagagaacccctcctgccggacggcctccgaactggaacatcagctttttgctgcctttggacttgaactgaaacattacctctccctgggtcttgagtctgcctacgttggcacgggaactacacgttggctctcttgggccccagcttgctgactcaccttgcaggtggtggtggacttgtcagctccgtaactgtgtgagccaatttcaatttcttagaatcacaaatttctttctttcttttctttttttcttttgagacagagtttcgctttagttgcccaggctggagtgcaaaggtgtgatctcggcgcactgcaacctctgcctccaggttcaagcgattcccctgcctaagcctcctgagtagctgggactgcaggcgcccaacaccacacctggctaatttttgtatttttagtagagatgggtttttgccatgttggccagactggtctctaactcctgacctcaggtgatctgcccgcctcagcctcccaaagtgctgggattacaggcgtgcaccaacatgcccggcccacaaatttctttcttttcttttctttttttaaaatcagttttctgtttctctggagaatcctgacaaagagcgcatatctgagaattttaaaatcatttattggaactattgaatctgttgtattctgtttttacttttgaaaatccttgcggctgggggaatgtacaccttctctcttttcctcttaaacattaaagcctgattcgaggtagaggcaactcactgttgtgatgtccttttatcccaacctcagccccggcagaaagactccgcgccttgggacattggtgttttccaggagtgactgtgctggggcagctgcctgttgcgatgagggctggcggggaacgatcccctctgagtttggcgtcacttatttggaaccctccagcagaaagctttctaagatgccacactataaactcattcatgcagttattgcgtttcagttcagattctattgctcttgcttcattatttcaaagccacatgatgatatccattactgggtgcagaatggccctgatgggtctagaagcaccgtggtctgacccgtcctaagagatgatccagtcacgaaatgctggtgcaggtgtggatcgagccagttatcttcactatctggaaacaagaccctgaagtccaggtggccaaggactgcaccagatctctttctttttttttctttttttttttttgaggcggagtctcgctctgtcaccctgactggagtacagtggcatgatcttggctcactgcaacctccgactccctggttcaagcgattctcctgcctcagcctcccgagtagctgggattacaggcatgcacccccatgcccagattttgtatttttagtggagagggggtttcaccatgttggccaggagggcctcgatctgctgaccttgtgatctggccgcctcagcctcccaaagtgttgggatttcaggagtgagccactgcactcagcctgcaccaacttttacagacaggctggagtcctgtctagaagtcaggacaccaggcctggctggcaccctattctccagaccacgctgccctccgcagccaggtcccaggacccagacataggtggatttttgtttctgacttgcattcgctcttttacatgaaccgtgaattctttgtcctaacgttattgttagggcgacagcattcctgatcgtggtgctaatgcggttatcaataggctccaaagcttatccttgatgctcacgatctcagagttggaagaggccctggcaagcacccaggccagtcttctctggtaagtgccctatgcccttaaaaccacctcaggatttcaaggacagagacaaattaaaaatagaggcttaattctcctgattgaaaagaagggaagagatttttctctcctttttctctgagcattactctttatttatttatttattttttgagacggagtctcgctctgtcgcccaggctggagtgcggtggcgcaatctcggctcactgcaacctccacctcctgggttcaagcaattctcctgcctcagccttccgagtagctaggattacaggtgtgtgtcactatgcttggctaatcttttttgtatttttagtagaggcagggtttcaccatgttgaccaggctggtcttgaactcctgacctcaggcgatctgcccagctcagcctcccaaactgtctcctggcctctctggtttcctagggaggccaaaagcctaacttagttgatcttgctccaagctgcaaaaccacctcctgtcatgaagataggagttcattcttcttctagatacagacaattaacaaacacagatggtaaccccagtgaccaggtggttctggggtcaacggtgtgtgacaaatggcactgtcagggcctcttccttaaggactagttattgtttatgttgaaaacacgcatgcagttagttgtacctgtttgagtctttaaaaggataagatcctttctttgcagtctcttagccattgcttgtgatgcatatcatcttctggcttaacggttattcaataatgaaacttttctttcttttccacctttgtggagaggtttcctgggtttagagcacacgtcttttttctttctttttttttttttttgagatggagtctcgctctgtcctccaggctggagtgcagtggcgcgatcttggctcactgcaacctccgcctcctgggttcaagcaattctctgcctcagcctcccaagtagctgagattataggcatgtgccaccacacctggctaatttttgtatttttagtagagatggagtttcaccatcttggccaggctggtcttgaactcctgacttcgtgatccaccccccacccctcccaaagtgctgggattacaggcatgagccattgtgcctggccagcacattttatttttaattatatttccccagtaatggccttacctacatttaatgacaataagtgatggatacttaaaatacactctagttctagaaggcattcccatacattaattaatttggttttcataaaatcaggaggcattaaaacaccattaaattagaaggcatcactattcccttttggtaatttctcatttaggaaaccgaggcactgaatggataaatgccacccaggggaccctgtccagccgttggcagaacgaggactggactgagggtatttggctcctaatccagggctttccccaggttccactgtgaggcatgcagggtctgaaaacacaccggcacgtgcgtgtccactgcccccctggccttagctatgcctttgctgtgttacggaagcacctctgaaggcctgggcgcctcttctgggagtttctcgtgtctcttcgccttccgatctgctctggccttgccacgagaaagcgacaggcccatgctgctccttggggcctggagacaatgtcccaaccccaggccgcaccctcgctttccatccaacccggcaactgctgcccgtggagggccacagtctccgaagtggaatgtggaaaaggaaaagtcattcgggctgtgataagaaagccgagcttcttcaaaggtaaacagaaacagagacaaagacgagggcacgtgtctgtgtgagtgagggagagagagatgggggaggggagcaaaacagaggcggcccggagaactctccagaagggtccgaaggctgccacatggaggagtggcactcactgtccagtgtgagggtggaccaggcttctcggatgtggtcgttccagcaggaaggccaaccgtgattccatatcgtgaggaattttcaggcagagccatctgtccacaaaaggggccatcccactggattcgtgtcctggtgttcaggaggacacggtcccgtcctcaaggtcgtgtgagcacctgagtcacccggatgccggggggcctatcctccagtgcctgagtgagagaggggtgaggctgggagcctgcattttctatatgttccctccccatgcaggtggtccccacacacaccccgagaaacagggtgttaagtcaccgccgctgtcagagagccacctggatgggctggatgctgggctggatgactcaaggtctcttccaagtccaaaccattttttggttgcatgactctcctccctagctcgtcctcacattctccatcacaaccagctttccctgaaaataaacccagctggccaccccttggagatgagggcttctcccaccctgcctctttctgcctgcacctgcccggcagccgttaccatgcatgcccatatacatatgagtgaatatgtgtacatgtgttagtgtgggcatgtgtgaatgagcatgcatgagtgatgtggcatatgagtttgtgtttgtaagtgtgtgtaagtgtgaacgtgtgtcagtatgtgtgtggacttgtgtgagtgtgtctgtatgtgtcggtgcacatgtgagtgtggatgtgtctgtgtttatgcccagtgtgagcgcatgtatgtgagtgtgagtgggtgtgaatgcctgggcatgtgtgccctgaaagccagcatggcacaccagtggcctccattgtctctccagcccttggatgctgtgtgggggatgctggcctttctgcacagaggccctgagcgaatttggggctctctgctggatggactgtggaagacacaccccggcattgttggacaccaagtgctggagaattctctccctggtgggttacagtatggggttgtttttctcctcagagtgtttacatggacagggcaaatgtgaaaaatccctccggccatcatgcaggaaaatatgtataaaggataactggagaaaaatgccttccatggacaaaacacagacagaaacacacacacacacacacacacacacacacacacacacaaacagcaggggtatctttcattgtgcctcaataaaacagaggttgaaggagacaccaagctagaaacagactgttaattttgggatttttttctttaatcattttaatataaagagacagcatgttacaatgacattttatggatgattataaattattatgaagtcctcaactggtaaaatgtcttgattttgttcccctgtcttggggtctgtggttaaatcatgacagaccagcagtggagtggagtgtgaagaactgcggcttgaggcttagacaagcctgggtttaatctcttgtttactggctgtgtggcctttctgaacctgttttctcacctatataatagggacaaaggacctatttcatagggcaatcgtgaagatgagagacaacagtgcaccagacgaattttgagttttaacctgtaatattatccctgatttaccttgatattttatagacattcatacattatagtagcaaacattttgagatgatatatacaagataatacaaattcatcttgcattttaaaatgttcagatttacttaaatcataatactttttattcttttagtgttaataaaatttcacttccttgagtattatataatagctttaacatttattcttttcgtatgaaaacgttttttaatgagccaattctgtgtgaagcttttggttttctataaaagctgctgtgttccaaggacacccgttgtacgcagcccctttgctgtgagatcatttccagcctcctttttgtattcttgtcatggcatctgacatttagtcattagccaagcaaatgcagcagttcatcatctcagagattaatctacagagaataaaagaggtagcaacgttggtgcgggagttaggcgagaaggtcccttctggaggaatcgttttgtatctagaacaccagggaattatgctcccgaaccatgcagccaacgtgaatctttgttaattcatctgaatgtttcctcagtaaaatcaacaagatcttcttcatccaatgttaaaaattgggcttcagcagtcaacactaagaagtgagaggcaatcaacggtgcagtatgaaaacatcatgagctagaaagaacttaacatgagatttagaaatctacttcacatataccatgatgactactgaaataaaacattaatcacctgtattcttatcactcctcaaaatgttttcttcctgtcccagggccctttctggagttttctccatgcttatataactgtacagagttgtcactttcatggagatgaaattgcatgcgttgctgttttgacttcacattgttaagtatttgtttgtgctactaaaacttcatggtgagcatttcaacgcccgtgtaatgctgcatccagatgctctgtaataattactctcccactctcctgtggctgtccaattatgtaatttcccactttaagtcataataggtaatgcacatccctgtgaccacagcttcgtgctctcagcccaagctccgggaggagaggactgggtcaaagcacctggacatttttgtgacttttgaagtgcattgtggaaccgtgtgaaggacgcttttctgaacgtgatgttccactttgatttgatgctgttttcttctgccagttcagaacgatagggtaagagaatactccgtgttgatggagagactcagatatgagtctcaaatgtgttttctgcgtaacaacgagatgggatccagcgatgcggtctgggcttttgggtactcacctttcctaaaagatgccatctgcttggagcagaataggctgtgacacgcaggagcccccagggaaacggccatggcaatggtgggtgttaacgagcaggcataagggactgctcccagcggtgcttcctctgaagtcattgccacctgcagcagcacaggggacagaaaggccgtttctccaggtccaggcagctcaggcccctatgagccctggcgtagcagagacccaggcttcttggtagaggcccagagccctgtactgccaccactgccggacgatgctcaggacctcggggctggcactgctggctctggtcagtgctgtgggcccaagccaggccagcggcttcacaggtgaggggtctgggcttggcatgggcagttcttaaggacaggggcttcctggcatgggtctcatgaggacagccccctgtggagacctgggcaggcaaggacgcctctgcttggagaggcgacatctgttcttttgtggacaagctttttggtaagcgcacatggtagcagctgtggaggtggggcaggagtgccgggtagggttttgggaagaggactcccccagtgggaacctgttgctgaatcacctgggcgttcgtgggggtaaaatgcagattcttagccagcaggtctggggtgcagggcctggaactctacatgtctgtgggtgatgcagatgctgtgggtcctcagatcccactgagaacagtgagctcctacagacgcagaagaaaggtctcctgaaccttggtgcattcaagtcctcacttacagatttaaaaaaaaaaggagacctagcctgggcaacatcatgagaccccatgtgtaccaaaaaaaaaaaaaaattagccagccatggtggtgcacacttgtggtcccagctacacaggaggctgggatgggaggatcacttgagcttgggaggtccaggctgcagtgagctaagattgctccactgcactgcagcctgggcggcagagcaaaagcccccaaacaaacaaacaaacaaacaaaaaaagccacaatacaaaaacaaaaaagaaagggagacccagaatggatcagggacttgcccaggccacacagctcacagggcagagtcaccacaggagccagaggctgcaccagggctctgtccggagttttcccaggcatgcggagagcagggcagcttcttaaaaacacacgggagttctgaaaccccagaatccagggaaatgggactgcggaattttaaaatcattttcctcttaaaatctgtcatattcagttacaaatttaaaggaatccattctgtttctaaaatcaactatgtttttgtactactttaacgtttttcacccagaagcaggattttgctttgtgatttgtgaaatggattttcccattggaacaggtaatgtgtagaccccacagttcagatgcataatgggtgggtatcctgggaagctggagaaggtcttaggaggtgtttccagaacccctcattgtatatgaggacacggggcagaacctcagcaaccccacacgtggtcgccccgaattttccctgtgtgccagcactgccttcacaggcatgaccccacttcagccttttgcagccacaggacatggctgttatttcacagatgacaagagaggggcactgggagggcatgacatgggcgcaatcatgcaacaggggtttgtgagcctgggtgtgagcacaggtccatctgaccccaggactcttgttggccccagagcattaggctttcccatctctgagaccggaatccaagacccccggctcctgctctgatggcccttgtgggtctttgcgggatggcaggatctgctaactgctttcttctctgggcttggccaagaagccaggcttgggatggcacgtgacctcggataaaatgttaaaaacaaaacagggcaaacatctcccgggttccacaggagatgagtgtgtgtgtgtgtgcgcgcgcgcgtgtgtgtgtgtgcgtgtgcgcatgtgtgcaggacggctctgctgcggaccagctggggccatgtaacgatcaggtggggccctggcacctctctagagaccaggagctgtaagtgtccttaatgtggttggcatctctgctcaggttacgatgaaaaacgcaagctagatccactctgctaagttcttggtgcaggaagtcctcggcctttgcctagctcggcgtggtcactgagtaggtgagcgcgttccttccggccatattccaccgttcttcatgcaagtcacctctaggctctcagccaagctgccctggtcccggaagctgatttgtcctgttccaccccgtacgatgaggacctcccgttcctttgcagagctcacagtaactaccccactggtgatgccaagcagcaggtggtccccatccccagaggccctgctgggcccgcagggtgatttggggttcagcccccagaggaagttgcagctccagtccctgttgcttgtggagtggggtcgctgtgcagcaagtgtgtggtccagcacctgtgttctgcccagagcaaatctgcagcctcttccctcaccgtgtttgagggctggctctgccctatttcttcctggggtgagtaacaagcccctggagtcctgctttctgcacacttgtaggttgctgcgaggtccaaggagggaatcttcagagatgctgccccagtggagcgaataaggacagcagtggttttgtgatcatttctgctcccatctctgtgttcctccccagaaatcaatccagctactcattgagggaaatcaactgtaatactgagcccccacctcttgggggtacagtctagtaaagcttagagctcaggggttgagtgtctgaaatgcaagcactgtatgtcaaatcctccgttcatcctgcactgagagtccatgtactcagggccccctgctaggtgccacgggggagctggaggggacccttcaccatccctgtgtgcactggctagggctgctgtaacaaagaaacacagcctgcgtggcttaaacagcagaaatggattcggtcacaggtctggaggccggaagtctaagatgaagttgcgggcagggctggctcctcccgagcccctgcaggagtctctgctccgggcctccagcttctggagctgctggcaatctttggtgttccttgacaggtagaagcatcaccctggtctctaccttctccctgtgtgcctgtctgtctccacatttccctttagtataagggccagtcatattgtattagggcccaccctaatgtctccactttaacttgataccctctgtaagacattactgcagataaggtcatattctgagttactggggtttaggactttaacacactaatttttggaggaacacaatcaattcaaactaggcagtaggggctcccggggagatgggaagcccaggcaccacgtcaggggatgtccatgaccaaagagtctcgtggtgaatgtcatggggccaggggtctcgagaacggagtaatcacgttgatggaggggcgatgggccttgtgtaaaggaaccaggctccagtgagagatatgtggggcccaatagggtaaacctgatgcttgtcctgcagcgggggtgactgtgcctcctcctgatcacagtggtaacggctgaaaagttgaactggtcttttttttgagatggagtctcgctctgtcacctaggctggagtgcagtgacatgatctgggctcactgcaacctccgcctcctgggttcaagcaattctcctgcctcagcctcctgagtagctgggattacaggcaccagccaccacaattttttattttattttttatttttgttttttttttcagagggagtcttcactctgtcacccagggtggagtgcagtggcgcaatcttggctcactgcaacctccgcctcctgggttcacgccattctgcctcagcctcccaagtagctgggactacaggcgcccaccgccactcccggctaattttttgtatttttagtagagaggggctttcaccatgttagccagggtggtctcgatctcctgacctcgtgatccgcccaccttggcctcccaaagtgctgggattgattacaggcatgagccaccgcgcccagcccacacccggctaatttttaaaaaatatttttgctggagatggggggggggtttcaccatgttggccgggctggtctcgaactcctgagcttgagtgatccacctgcctcggcctcccaaagtgctgggattacaggtgtgagccaccacgcccggcctgagctggtcttttatcatcaacaaacttctcacacacttgccacagagcgaccgcactccacaggtgctttaagtacctgcttacttatcttccacctcattgaaaagaaagccgtcattgtcatgtcctggccacagcaggccttcagtttgcactgtggagggaactgctgcacattcacttcccatgtggcaaccttgaggctcagggggactaagagatagatgtgcacgagattctacggcctgtggaatcagctcacatggagcagaacaaagggacgtgatctctaagcattgattccagcgctgtgctctctccttcgtatatggaccgtgagaaccctgtgcttcaggaagcatgcgtggggcccaggtggcacctcctcctcggtcacagcggctttcttagcaggccaggctacgtttatgctttattcttctgtgctcactcatgcaacagccttcctggtgcactagcaggcaaaggccagtggagagggctggtgggcagcttctgagaggcctgcgcgagtgcgggaggtgtgctctcacttgctattgcagagggacgccttgcggataaccgctcgcacggatctgatcctggtgttctcagtcgccttcttgcttggcctctttcagaaaaaggcctctccctgttgggctaccagctatgcagccaccgtgtgacccacactgtacagaaggtggaggccgtgcagacgtcctacacgtcctatgtgtcctgcggcggctggatcccctggaggcggtgccctaagatggtttaccggacacagtacctggtagtggaggtccccgagtccaggaacgtgactgactgctgtgagggctatgaacagctcggcctctactgtgtcttgcgtgagtccagggctgctgggctggggcggggccacccttgccgtcgagacgcctgatgggacagtcaccgttggcatccattggccccgaacttgctagatcttccaggagcacggctcccagccttgaccaggcagcaggtcatcggcagggctttccctggccccactcctaggtttctgagtccgtgggtgggggtgaagtacaagaatttgccctcctgacaagttcctgggtgacgctgacgctgctggcccagggaccccactttgagaacctctgctgttctcagagggctcctggatggctttaaaaatgcagatgcctgggtctcttcctgagagagtgtgagggaattggcccggggcgttgagagagtgtcggaagttttcaaagctcccagagtgattctcatataccactgagtgtgagagccagcactgaactctcttctacagcagccttttctttctaaaagctgcagtgaaatgctttcgtagccaaaatcctattctgaactccaatacgtgaaagagctggaaggagccccgagcctaccaccctaagtgctcagaggcccccaagtcctcccagttcctcagtgcagtttggaagctgctttcctgtaggatgcttggggccagttaccagggtgacctgtgtggttatgccaggccagggtctgagccgttgggatagggcagggactcagggctcagcctactgacacacaggtgatctcttccaggggaggggtgtgtgtgtgtgtgtgtgtgtgtgtgtgtgtgtgtgtgtgtgtgtgtgtgtgtgtgtgtgtgtggtggctgctaattttgagtcaataccagatctgcaatgagtttctgtacagtcagaaggtcctgccttgcacccccactgtggagggatgtgggggtgtgtggctccagcttggtgttggccagggtcactgagacataagggctgtgacctccagagtgcagaagccaccagctcctgggtgccacgaaggggatcctgcaggacccatccttgtggcctgagactgttgtacccaggcgagttagagaaaacgccatactttgagacgaattaagagtcttttattagccggcgaccgagagacggctaacgctaaaaattctctcagccccgaagaaggggctagattttcttttatactttggtttagaaagaggagtgggggtctagttaaaacaattttacagaaataaagtaggcaaaaagttaaaaagataaatggttacagaaaagtaaacagttccaggtgcaggggctttaagactattacaaggtgatagacacgaggctttgggcgttatcaatcagacgaattcctgggaactgcggatatagctcgccacagtatcttatcagttaactgcattcttggatgtgctgggagtcagcttgcacaagttaagtccttgaggaaggggctgccagtgaaagaggcaagatggagtctgtctggctctcttagctaagggagagtccattcaggtggaaacaagcctaaaaacagggttagtaaaaacaaggttgggcattacaagaccaggacaacagcagaatggagcgtggactccgcaaaccagggtgtctgcctcctccagaaaccaagggccccagattgtagagtctggggtctgcatagacctgcaggctgggccatcctgagtgggccctccctcagcccccagtgctatttcactgatgacagggagagttgatgcgtttctgttgccccgttcagagggccaggcagagagagggcctgatggtttcgggtgtgctgttaacaggcatgttcctctttcaggagtgttaaaacaataccaccataaccaacacctccatcaccaacagaaaccaggcagggccagctgaccccagagcaacacctccatcaccaatagaaaccaggcggggccagctgaccccagagcaacacctccatcaccaatagaaaccaggcggggccagctgaccccagagcaacacctccatcaccaacagaaaccaggcggggccagctgaccccagagcaacacctccatcaccaacagaaaccaggccgggccagctgaccccagagcaacacctccatcaccaacagaaaccaggcggggccagctgaccccagagcaacacctccatcaccaacagaaaccaggcggggccagctgaccccagagcaacacctccatcaccaacagaagccaggtggggccagctgaccccagagcaacacctccatcaccaacagaaaccaggcggggccagctgaccccagagcaacacctccatcaccaatagaaaccaggcggggccagctgaccccagagcaacacctccatcaccaacagaaaccaggcggggccagctgaccccagagcaacacctccatcaccaacagaaaccaggcggggccagctgaccccagagcaacacctccatcaccaacagaaaccaggcagggccagctgaccccagagcaatggcccttctgtactctcattggttccctagagggccactggcaggacaagcctatgccttggccatgctgctcaggtgctggtctaaggagacccttcctgtcctgatgcctggccccatttccactttcttcgagggccacacacacagaggggcctgctgagctacagttgctgctgtgcaacaactccactcctaggggatagcggggggccattaggacacaggtgctggtgccacggcaactcggtttagagcatgtgggctttgcagtcaggacatgccctatcctgtccagtcttacctgtgaaggccacacctcttcctacctgttggcattgtcaggactagtgaggggaggaggccctgggggaggctgatcagcagccccttcctgctcccgctctgcagggccacaccagccccacccatgcccaccatcaccttctgtaagagaccctggcctgctgcagcaaacaagttaattccctcccagaagatagggaggcctctccccaccacctgccctgcatcctccttcacagaccagcctccaggaagcgcctcttgttggaatcagccccacttttagagtgttaacacctttaattagggactcaccagggcgatgcccttgcagtcagggagtcccgtgggtgagagtgggctgccctggggagctgcagggagtggagagtgaggccacagggagggacgtgaggcatgaggggaggtggactcaacctgtgggccctgagcccctcagtaatggcccctcaggttctagaaggctcactctggcacagtgaagagggggcagatctagaaggaggaaggaagagaagagggagggaaacaggcactgcctgagtgcattctttctaagaggccagggcaggagaccctccaatccctcgggcaccaaaggaatgagtatccctggctctgcatgtggggatccaggctaggggaggcccgcgcctccaccaccatggcacagttccaggaaggcaggctggggatgtggaccggggctctctgacccccaggcagatttttgggggtttaccaagctgcactttagtataagggagtttgtggcatttgagtgctgtggctgtggcgactgtgggaggaggaacatttcagggcactgaggacacggagttctttctcagaaaggtccctgcctgtgccggggcctggtgaagggcacagcccacgaggcttctgcaactcctgccgctggagggcctgtatcccatttcttcccagccccacggtcagagacaccatgctggtggtgtgaaggcgcctgtggtgggcggatttacaccccggattttggcagcgcgaacttctccatgcttgcacagctcttttgatcaaagccgcctttttctgggatgccacacagcaggttggctccttggagctggatgtgagatggtttcagtaagtgacctgttgagcaccgtgactctgatttgtacagaacgaagcagggcccgaagctggacctggcagatgttggaggcccctggaaatactgggaagcgtgaagggcaggagatgctccttcctctgtggcggggcctccaggtcacccgagtgtgggtgactcacacctcagctacccgggggtctgcgcctcggagtcctatcccccagacagtggtaaaatgccagacatgtttcctcctttctcctcccactcaataatgacttatgcaaaaaagggaacggaagcatggacacacacgtgatatgactttcagtgactttttcaactttttcagtccagcatttggaatgcgatgacaactggtgcattattttaagtttttaaaaatataattacagaaatgaacacacgagccatacagaaaatttggaaacacagaaaagaacaggaggaggaaacgatcccaagcctgctgctcacgaataaccacctttcacatgttctttatccagggcagacatttcacaagaggatggccactgtgtccaagacatttgtagcacgattttaccactcagcaatgtatccacagcagctttcatgcctgtgaacatgactccactgcatgcttttacggccacatggcattacctcatacgcacatcagcattcattgagcaagctcttgccacttaactgtcagttgtttccaattactcattatcatacataatgctgtgatgaacatcataccgtacaaacacgactgtgcacaagttggattatgcgctgaggatgaattctgagaagtggaacccagcatcttagctgtgctctgttaactccagtgacaccccagctctgcacaggatcaacctcctggcaaactcagcctcgttaggcaagtccaggacccccagaggaccaggagactccccaaaacttcctgtccccgcatgctgatgaccaggggccctttggtgagaacctcctgtcccgaccaggcgaagaggccccgaggaaggaggagggagacaggagcgactcctcctcagcccacccagtcctcagccctgggagccttgggttttgttgctcaaacacaaagctcccctgttgcctcactggaccatgactagcagtgttgccaggagctgagcagttctgttttattgtttgcattgagttagggacgaaggagatttgtgactttctaccaagttggacttgttcagcgttctcagggcactcagtcagctggccagctccaagggatggaggggcttcccggcagtagccagttaagatgcaaacctttcacttaaaaacacgcctctggtgattaggcaactatttttagaagccagttttggggggattgtttctatttaaataggcttttagtttagaatagttttagatttgcagggaagttgcaaagataatgcagaaaggtcctgtaccccccaacccagcttcccctaacgttagcatcttacagctctcgggactacttgtcctaaggaactgacactgggcattgtcgggaaactccatagtttatttggattcccctgttttcccctgaatgtctttttctgtcccaggagcccaccttccatttagtccgcatgtctgcttaaccctgaggcctttgctttttgcactgggagacaaagcagagaccttcggattctcagcaagcctccaccaggctcctggcgttgccctcctcgagctgcacccaacgttcatttttcatgcacggccatcggtagagctgcctggatgatgaggagatgaagagtgagtcagggacaacgcaggaaagagagtgcggctgagaggaatgcccacagcaaggccgggcgccaggcagacagggctgggtgaggagagcggggatgcaggctctctgcatattccgtgactctggctgcccctgctctggccagctgagcagtgtccttggtgatgtggtcccagcagaagccagggccgccacctctttcttcgttgcagagtgctctgcagagaacttgggggacccgagaaggccagtccctgggactgcagcctgctgaggctgcccttccgcttggccaatcccacgagttttccccaccctcgcgggggtgagtccaggacccagttaccagctggcctcctctagtcttctgggctctgagaggtcttgagctgtgctcctaaacatccccgggccatagacacacaaagcttgccatgtatctgggcatgaactggacagctctgagtaaagccccaggggggcatggcacccaccgtcagggtggctggctatggaggccacagagctgggcaagccttctctggggcccagcactggggtccctcctccctctgtgtcctcctcatggctgccctcagcctcgtcccggagctcccatcttctcagcttccttccgtcctgggagatggggtcatctcctgccctgggcccacctctgccgtcttggcaaaggcacactgcaggctctgcggcatcgggcacacgctctgctgtctcctgacccctggggttcggtttcttctccttgccctcctcttgtgcttcttggagccctgagcatcagcctccggactcctgacagcttccctttgggtggattctcagactcctgcagtgctttctgagacctctataagcccctttttctggaaagcccaccgtggcctccccctgcagccttggctgaggtctggtccccaggaccagcacacctcccatggggaccccaccgggttggcctcttgccttcctcatctttgcctcctgcagaggctggccgcgtttctgtgtctagagctgcatcggagctgcactcacactgtgaagggctggggagctgtgcagccaacagccagcgggctggcctcaggggccacctccagtgccactctgccatgcgtctccacatgggcgagcagtggacatgtccgacttcacatttgcactgccacactcctggtctacaccaggccgttcttcccgcagctttccccagctcaggaatgaagccccagggatgccagacccgaagcctgggagccttcctgaagcttcttcttctcttacaccccatcccgtctgtcagcacatcctgtggacgcccccacctgatctccccagggacccatgctgcactcacctgcactgtcacctaggtcggcccccaccacaccccacaccaggcctgtacctcgccttgtgggcgccagggctgatgtctgcagagctgctccgagctcccctctgcccagcctaggcatgagcccctctccagagtgtccttccaatcccccacactgcttcattccctgaggctctcaccccatctgaatatctgtagatctccttgcactattgttcccccactggaatataagttccctgaaggctgggccctgggcacccggcattgtgcccggcacatagcaggtgctcaacaaatattgaatgaatgaatgaatgaatgaatgagctatcaggacttgaagcagcaaggggccctttcagggggtggtggagccccctggacctggacttctgaggcctagaggaaacagagacacctaggaccccagctgaagctgccctggaaggacagatgggcagaggatatgaaaaccaaagccaatggccctccaatggggtgggtgtctgcccaggcatggggatgggccccgaacaggccacagacctacaggcagaattcagcaccaggaagcaccgacgtgaggtccccgtgcagcaaatcaggtttgtcttttatcgccagtatcattaattgtatcattttctcccagccctgaatcagtccgggcagttcacgtcaagacctggggcctgccccgcagaggggcctgaaccatccacctccccctgcagcttggacatcgactgtcctggacttgagaagtgctgcccctggtcaggggggcgctactgcatggcccctgcaccccaaggtaggctgctgcgggccatgcttatggacaggcagcaaaggcgggtctcggtgaggcctgatctgtgtgaaggtgtgggggggagtgtgtttctaggagcagtgaccgatttcatcaggagcccccaccgtgtgcacaggcagcacctgctcttagataatttcttagtcaaaatctggccactgaactctcgggggagaaatctcatggcgctcttaggggccctgaaatgggaagacacttctggtggagcagagacccggatttcccagtttgcctggagaggccaggagctccaggtagattagttgcaggtgtggagctggctgtgcctgcagtgccacaggggcctgacgagcgccacagcacccgtaggcaggccctgccacctcagatatgcgcctgctggtctggaaagttctcttttgattggggtctgcatccaggagaatgggagaatgggatggcctatacatatatatatatgtataatgttacatattatttaatatttaaaatattatatattatagcgttagtatggtatgcagtaataaagcaatagtatacataatatcagatattatgataatactatatcattatactacatgctattatatagtatatatcatattacatatgattatactatccaatatttgtagtatcaataaaataatgacaaagtataaagtaattttctatatcaacatactatgacagtataatgaggctgataggctctatttacctcctaagcagatctcttcaagggaaggcctgctgctgtgggtcccaggcccagctcacctctgagcagggatcggtggtcttcagggacattaggatggagaggagcgaggggcgggcagtgaggacatcccccgtctcctgtggtagatgtctttttgcagggaggtaaatgcagagcagggcctctcatggcctctggttccctctcctgccccctctcccaccccagcagcttttgtgacttcaacctgtcctgggtccataatcatcagtgttttcccttgtgtagctccagagagggaccctgtgggctcctggtacaacgtcaccatactggtgaaaatggacttcaaggaactccagcaagtggaccccaggctcctgaaccacatgcgccttctgcattccttggtaggtgagacagacgggggctgcctgcaccctccttgtggcagctgctcaggcagacccaggtatggggccgtggaagggacctgggggttggggagggtgatgttccccaaatggccccaaatgactgactctgaacgaaattctagttcttaaaaaatcagcttcaaagaggtatgatttacatgcaacaaaatgcacacaactgaagcgtgtagttggctgagttgttatgtgtgtaccctcataggcccgcctgtcgtggtggagaacgcggatccctaagcttgcaggggtctgcagtcccagcaaagacagcctaagccccgagctcttccctcaccaccctcagtcccaatttcttcaagttctggctcctgcttcgtggaagccagcaccaacctgggagtgctgagatgggaaccgtagcccagggctggagagcaccctggggtctgatggttagcagcgcccctggcctctccacacaagtcagaagcacaccccagggtggcatccaaaactgtctccagacgtcgcccactgtcccctggggataaaaacaaacaccctggctgacccttgctgatgacacaggtcatgctttctggcccatcagcagtgattaccaaccaggatgtcttctccagctcaggccaccatcagtctcgggaatcccagtgtggacagggcgctgcgtgtccccaaggctgccgcgtgtccccaaggccgccctccctgggggatggtctggcttcaggaccggctgctgacaggggcttgtgctcagaggggcctcagcttggtctaatgtgctgctgttgcctctggaaatgccgaacacttttcagacaaggggccccgcattttcctttggcatctgtgtagctgttctgtgcttcagatcttttgtgtgtcccatatgtccctgggtgtcttggtgtcaaacccagggttgggtcactccttggccgttagactaagctggctggcagcccagatcagatggtgcacacctcatgttgttctgggctgctggccagtgagctgctagacaggtagtctgcagcctcggccttaacagcccgggctaggagtgattcctgtttcctcttagcttgttaaggggactgcccaattggccagtaagaaactagctctgaagccacactgcctggccctagtgttgccactcatcagctgtgtgaccttgggtaagtcacttaacctctctgtgcctgagatacctcctccattaaacataaataatcggccaggagtggtggctcaagcttgtaatcccagcactttgggaggccgaggcaggcggatcacttgaggtcaggagttaaagaccagcctggccaacatggcgaaaccctgtctctactagaaatccagtaattagccaggcgtggtggcacgtgcctgtaatcccagctactggggaggctgaggcaggagaattgcttgaactcaggaggcggaggttgcagtgagctgagatcgtgccactgcactccagcctgggctacagagcgagactcttgtctctaaataaataaaaagtaaataaatagaaataatcataaccctgcctgagacagggccatgagcttaaatcatacatgtaaagagcttgagatggttcctgagcttcctgatgcgtgtggggcctgagatgttgtggttgttgtgttttcaatattgctgcgtgacacctgctgtctcctcgtgcatgtaggtttcatgtctccaaccagcccattaccccctgcagaagcgcctgccttgcacaggggtcaggcaccagcaggggctggtctctgaggcctgcttctgctgctgaataaggggttccgatgaggtcggggctggttcccagttctgtatgctaaattatgagctgcatctcctcccaggaaggggcttcaagtgtgtatcggaggactcctgctctccccaaacctcctttggagttcccagtggaggcttgggggtttgctggcaaagtttgttctggtgaccactggtctggctgtgcagctgccagttcacctggcttcccaagggttgagatttcaagatattaagctgaaataaaaatactgcatatgaaatgaggaaagtgatcattaaacctcagaaaaataattggatgtgtacaacaggagaccgtggcttttgatctctaattgtctaattctagttctaattctctgttgtcagctgcaagagacctgcagtcttggcaagggcagaagaccgagggtcctgggtctggctgctgtattagtgtcctggggccactgtaaccaaggaccacagactgggggcttcaaacaacagaaacttattctgtcacagttctgggggctgaagagtctgaaatcaaggtgtcggcagggctggttcctcctgaggcccccaggcctctctccttggcctgcagacggctgtcttctctgtctcttcacactgtcttcccccattcatgtctgtttctgtgtccaaatttcccctttttgtgagggcaccagccatattggattagaacccaccttcactaattatatctgcagtaaccctatttccaaataaggtcacattctgaggtactggaggttaggacttcaacatatggattttaggggacagaattcagcttatcacaactggtactgaaaggtactgatagttccggtttgtaggacttctattgggatagtgatggatagataagtactgtagaggttctttgctgaagagcagaatggtacgtgtgtgtggacagttcatttcagctctgcgggcctcagtctcctcgtctgtctgacggggtgtccttctgctgtgtgacactctgattctgccttcacaggtcaccagcgccctgcaaccaatggcctccaccgtccaccacctgcactcagcccctgggaacgcctccaccacagtgtcgcggctgctactgggcctgccacggccactgcctgtggctgacgtctccaccctgctgggtgacattgcgaagcgtgtctatgaagtgatcagcgtccaggtgcaaggttgggcttccctcaatcctccctctggggaggctgcagggtggtgcctgaacagccaaaatgcaaggtggacgctaaagccagaccagtcctttgtcttttaaaggaggtttaagttcaggagcaaaagaataactggttcaagtgtgttcatcccacaggtgtgggacccatcttcagctcaccctgtaaattccaagtccccaagtgcagacctctagaacttattttgccccccatttcccgcccctctcctcttccctccatctctcctcggatccctctggcctcctgccccctcggcaggcttctccttccatcctagtggacactggagtgcaaatcccagagccacacacaaagaacttgtttcttcatttctttggtttcctaaatttccctctcgcctctttcccacccttgccaaggacatccttgtactccaaaggctccttcagcacaatttgtctaaagttgaatttgtatctggcaaagcacatagacgtggccttgtttctggaagaaattacctattctttgttgttgttgttctatgtcaggaattggcaagcctcatctaaaagggatcagatagtaaatatttttggctttgcgggcccacgtggtctctgtctcaacgactcagccctgctgttgtagtagtcacagacagtccgcaagcaaacccctgggctcccgtacggcttcctgtacccaagcaggaggcagccaggctagtctgctgctcccagggctttgcaggagggtggctgccttggtgaagcctcttctatgacactgaggaggcacgtgacaatgccagggctcagagccgtgtgaaagctctagtgattgcattgatctcccttcagatccgcacatgttctgcagaaccaagctgcattgctctagtgccattaagcaaagtgctcgttctgtcatctgctctgtcaatgacctttggccagaggttgcaggagcacacctgtgggtggaccagttgagtttattattcgaggcagcgagggagaacccacaccatggagaaccatgtggtttctcagtaggagattgttagaaagaacctgttataggatgtgggttttgactgggtggtttggggagggtctagggaagtgtgattttgttctgaattgaatgccatcagaaaatggaggcaactccacgactgggaatgtcaatacatctaagcaaaagagatgggaacaattgcataaagataagccatagtttgtaaagaactaataatcactcatttgggccaagggaggggcattagtattttgtgggtgacacatgagcttatcgcgctgtctgtacttagacagcattatgaagaggccctgtctgaggctggctgctgtgagatggttctgtttgggaggcctgggccagcctcagaacgtcaggggtggctctgggtttccttgttggcgcagaaaacacccactgatttactttacgcttggggtgggatgttttggccccaccttttcatgaccactcagactcagtccagcccagagtgatttgctcacgtgaggctgcccggtgagccagccgcgagccctgcctgaacgtgggctgctgcttggatgacgatggccagcagccgcacagggccttctaagacgagacttccatagtctcccttgggatcactgcccaaggcacccctcaaccgacgtggcacaaatccgtggcacgagtccacagaggccgtgtgtgtgcaggtagatgaagatgacgaggtagctgcgactgctgagtgtgggtcctgctctccttccctgtagatgtcaatgagtgtttctatgaggagctcaatgcctgctctggaagggaactgtgcgcaaacctggagggctcgtactggtgcgtctgtcaccaggaagctccagccacgtctccacggaagctgaacctggagtgggaaggtaatggctaggctctctcagatggcatgggaatggcttaattcctgtttgccccgggaatactcaccagcagtgcttacagctgcagcattcaccccgagataactctgccatgaaatatcttgcttttattattattttcgcatcactgtggtatattgactttggaaacagaggacacaattctacttatagcattctgcttttagtagtggtatttccatttacaaaatatagtgattctcaatcactgaaaatgtcaaatcctagaaaacagcagtcccacgtgtgttgttaacattgttctcgaacaagttgttggccgacgattcatttgctgaacctgtttttctgaaatagatgattctgatgattcagacagttctgatgttagttctgtttagaagtaattccaagaacagtttttatattttgttttcatattgaaaatcagttagatttgcttcagccccaaagagcttgtttatgtaaaattaaatgagtgccggcagtgagctgccgtttttttcttcgaaacgggaaaagggtgaaggcattttttaaaggctggatggtcttcagaccacagggactcttcttgccaagagggaatggctggctaaccggcacagaatacacttagttctttcagccattattgatctcctagtgggccaccctcgcatcttctttggcttaggaaatgttgatttaggtgctattcactgtgctaggtgctggtaatggaagcatgcagaagcaggtcctaatctctgcctgtctagtggattgtggaaatggagacattttggcgcatgaaagggcaggactgatgtctgcactggaaccacgaggataagctgggaccatccctagcatcgcgggatcagcctggagagcagaagagcggactgggtgttgggggaagcatgtagataaacgtgcccaggtctgtccctgttgggagtggggagggatgtaccagccaggactggcacacgggattggctctgccatcaagcagcttggaagaagaagtaactgtgtaatctgaaatgtaggaaggtgctataaagacgatactctgagtgcaggagtctagggtgtggaaggtggtggagaaagggattccggcaacattttagagatagaacctctggaacttattgattaattcagtgaagaagaggaaaaaggaaagaagacggaatccagatgtcttgactgaacagtggagtagaaggtgtttccattggagaggatggggaagacccgagctgttgttattattgtcaataatagttatagctgagatggagtgagtggcggtgccaggatgctgattgagttggacgcgtggtgctggagcacagaggcggggctgggctgcatacgtgagtccagggtcacctccaggtgacacttaaaccatggtatggctgagagaagggaagaggcctggggcctgtggccagagaaccccaacagtgccaggtcagtgcaggaggagaggctgcagatgacctgggtaaggcaggaaaacagctggaagggcgtgcgcagcaaggtcagcagggaaggctcagcaagccccaagcgagcaagcggtaagctggccggcaagcagggagggtacacgcatgggtaacagcagggcaggaaagtgcctgtgggaactacggggatccggtgcagacttcaggagagcagaagggaagcagccagcagcccgggttaggaagacagctggaggagagaaagaagcgagaatagccgagaatcctgcagggaagcttgactatgaacaggctgagggaaggaaagcctgatgtggaggaggctgtggactcccagggggtctctcaaaagacaggcgaagctgatcccggctctttctattccctgttcctttccaggttttgaccttattgaacgcagggttgagggtttttttgtttttttttttaaaccttatttaaatcctgctacatgtgtaattttataagctgctttcttcagttcctataatgtgtataaagtttccaagaagaagcctggttttcaccatgataattattggtggttgaaaactagtggctttctaaagcaatcatataatattctttcccctcacgggagcacttctgttgctttcaagagtctggaactgtaaccttgtgacaggggttacagggaatctctttatatccaatttgaattcgttaatcatttaatttgcatgttctttttccttaaaagggactcaacattgaggaccatccctttgttcacaataacaccacagctggcagttgcccgcacttcacgcgctctgggctctgctctgagcactctgtgggtattgcttcgtttaaattcttagactaaccccaagaggcaactactctccttaagctcattttttttttcagaagaggaaattgagggggacgaaggtgattttcttgcataagatcccaaggctggtcctctgaagacgcacatgaaccagctgtgtcccaaggctgtcttccctaggagccctctggcggggacctgcctgagagtgtgatgggctctcccccgccctcgggggctgccttttgtcccagtgcactcaggaaaaccgccatgccctttccaaccttcatgagtgcttaggaccaagagttgggtagagctccagaagagttgaattattttatttggcgttctagaacccaactaggaaaaggagtctaaggttctggtttatttatttatttaattaattttattgtttgttttttatagagacagggtcttactctgtcacccaggctggagtgcagtggcgtgatcgccggtcactgcagcctccagctcccaggctccaatctcagcctctggagtagctgggaccacaggcatgcaccaccacagccatgcgccaccacagctggctcatttttaaatttttttgtagagacgaggtctcactgagtagcccaggctgttctcaagctcccagcctcaagagatccttcctccttggcctcacaaagcgctgggattgcaggcaggagaccccgtgttcagcctaaggttctgattggctcttctcgttgtcctgtgggcgaggggttgggggagtggaccagttcccagagccagctgtggatgtggcgggctccagggtcagatcttccccccatcaccaggaacgttcccctcctatcagaatgaggctgtgtggggagagcggacttgccctccacccactggcagatgaatccctggtgccccgcaaagagcaggcactccacaaacgtttcctggatcaatcacggaaagagaggttttcacagtggtcatccccggggtctccaggtattaaaaatttccagcccagctctgccagcaaaacactgagaacactcctgtaccccgcagcacgtggccttgagatccacttagaacttcgcgccacgtccacatcccacggcaccccactaagctctgcagagaactgtctatagattcctgctctgtggcttccagggtgagaatcctgtccctttcgtgagcacagaaggttggaaaacaggtattttccaaatagttatttttaccctggtcagtcatccggaaaaatattagattctatttacggttaggtttgttggcagtcacactctgccgtgttgcttggcacagtgaactgccagattgcgtcaggatacagggccgctcgagcgaccgccaaacacaaagaggggaggctgcgcggccccagcttcacttctaatagggcaggacacactaatccagtgtttccagatcagcagtttagagtgaattccaattgcatattgctaagggaaacagcatccccggcaccttccctgctgaaccagagatgagtcacggctgcccgggaagaaacaagggccagactgtcagacgtggagaacccagggtgctttacccagatagaggcaaagttctgaacttgtgttcctagctgtggttggggagggctgtggagcaagggctctggggcctgaagtttagattatccgcattgccgtggccttgggtcatacaaacccagagtcaagagcatcattttctagggccacatttaagggggacactgaaaagggtccccatttaagggtaaccaaaggagggtgtcctggctaatgaaaaaccaaaaaccaagttataggggcctaccctggaagagaggagtcgggggtagaaggaagatttccagttttaaaataccccaaggtctgtccaacaaaagagagattggccttagcacgttagaagttggttggttggttttacaacacaaagaaaactctccaagctgtgctgtccagccacgggaacagctgccgtgaaatttcgtagatatgtaagtttcccgggtttccctaacaaaggcccatgaactgggtggcttcaaacaagagaaatgtatcctctcacagttctgaggaccagaaatttgaaatagttaccactgggcctaaatcaggttgccagcagggctgtgctcccaggaggctctgggagaatccattccttgcctctctgccctctggtggctgccggcattccttggcttgtggctgcatcactcctttgttttcttctgctgtttttttttttttttttttttttgagacagggtcttgctctgtcactcaggctgaagtacagtggcacagtctcggctcactgcagcctccacctcctgggttcaattaatcctcctagctcagccccccaagtagctgggactataggcacacatcactacgtctggctaatgtttgtgttttttgtaaagatagggtcttgctatattgcccaggctggtttcaaactcctgggctcaagccatccgcccactttggcctcccaaagttctgggattacagatgtgagccaccacgcccagccctactccatcttcaaggtcaacatctttgttttttctctattccagcttcataccgccttctcctttgtgtgtgtgtgtgtgtctgtgtataaatccccccgattctcttttataaggacacttgtgattgcatttagggtgtacctgggaaatccaggattatctttccatctgaagatacttcactgaatcacatctgcaaagattccttttccaaataaggtcacagtcgtaggttgcagggattaggacttgatatctttgaagctcattattcagcctgctactggtgataggaaagcttagtagtaaggcaagtgaactttgctatttcctattgttcagctttgccatttactacctacttgacctttctaggcctcagttttgtcctctgtaaaatggggatcctagaagaacttattacctgggattgctgtaaggactaaataggataacatggctggtgcacacagtacccaggaaacattacctgtaaccatgtcgctgatagcttggctggtttgtgacatggatgtcatgggagggagtactgcagggggctcacaccagggagttaatttatagctccctgcaagttcctaccgctgctataatgcatgctgcgttagcttggacactgtggaccttaactcatcattgttccctcagtgtttatggtgatgctgggtgcatagtagaagctcaattaaaaaaaattgagccataagaaattggtgcccttattggtcaaacatggtcaaatatggacaattccaaatgcttcaaggtaacacactggagaaagggccacacagatattggatgggaacattgtcctcagggataatgcatttctttggattagatgagattcttttaccccaaatgcttgcaatctctcttagttgcaaaagtcactgacggcagcttctgcagatgcctcggagggcttcacagcatttgaaatgccaggtttgcaggtcccccatccagtgatccaaaaaccccctggcatcttaatttaaagagtaaatatacttattaaaagaggtaaagcatgcattgccagccccgtaccctgtgagacttctttccaaacaccattcctctgcgttcttttcaaataagtacgggtgcccttttaattttaactctgctccgttcagaagcactccttatagaatgcgtttttaaatggcctgtaatctgggtgggccatctgttgtcccacccatgtgctctctcgctctgcgtcaagtttgatatctgaatggcaacaaggaggcaaggttggagccctgggtgtgggctggggggctgctgttatagctgctgcgcctgctcgtggccgccccactttcctgtttgcagggcgttttgctgtcacaccatcctccaccaacgtggattaaaaaaatgcttggggctgtgtcctgactgtacaaaaatagaacagtcagtgcttttagcagactttttggaaaagaaattgtagcccgcccttcctttttcagtgagacatatgttcccaaggaacagactttaagaagccgggtggttgttagaaggccaggcagtgagtggggggtctttttgattccagggttctggtgaccctggagacgggggtgccacccacaatctcaggtcccaagctttgggccaccctcagttgaagcatttctgcttttcttgccactaaagaaaatatcataaagaatgaatccatgtctgtttccctgaccagtatgccgaaaatcactggacaatcctgtaaaaagtatagatgtgtcttttaaaaaactacattctaccccacatcctagaagtgttattaggacacatcagaatttggatggatgtcactgatcctgtctgagtgaagcctgtccagattccagtaacagatgctcatctgctgggaggtggagtggcaggttctcagtgagggagctcacctacacagggaccaagattcaaaggaggcagctcagtctcaggttggaaggaggagacagcagggctatgtcgcgtggtggtgactgggcactaaattggattctgagcctctcagcagccaaggcgcaaagggaaatgagttggacagtgttgggttttttttgtttttgtttttgttattgagagaaagcaggcacatatgtctaaaagcagaattcttttcatgatactagaaagcatatatcctaccagtccttacagaaaaggctttgggaagccacacattataaaattattattttctttaccatggttttgcaaaatatatttttaaaagttctttgttgcttatttttatagagcttaaattctgatgtgaaaattttggtgcgtagactgggggccgtctactttttatataattcttactgcccagacacttgctgtacagccagaatgtttttaaccaaaaaagagcttcgatgctatttgagcactagaatatatataggttggtacatcagagctttgctctctgaggcatggatttcaataggaaagcataaaaagggcaataaaggaagctcagcctgatttctgagtccggcttcctgatgaggccattgtttatggagtgatgagtcagcccagtgcagaagttctcgtgcaaatgatcaagtgcttgtcatgaatcagagcagcccagggcctcaggagaggctggcaaggcagtatttgtagatgtggcacagaaaccttacactgtcgtggccattgctacaaatgttttctgtacgatgactgtatacgggtccccagagagactgttctgactttctagtaaccaccgattccggatcccagagagccccacgactcaatgctgttcactgtgtagacagaggcacacttggatgactcccaccctctaacttggctcagtgatagagaggctgggatttcaacttcagacctcttgcttctccatttcatctcaaatatccccatcacctaatgcaatcctgagctaccttccaaaattactcagaagcctagagagagagaagattgatacctctgttttgaatgaatgggttgcatttattattggaaaaaaaaacagtgagtgggtcaggtgcggtggcgcacacctgtaatcccagcactttgggaggctgaggtgggtggatcacgaggtcaggagttcaagaccatcctggccaacatggtgaaaccccgtctctactaaaaatgcaaaaaattagccgggcgtggtggcgagtgcctgtaatcccagctactcgggaggctgaggcagagaattgcttgaacccgggaggcagaggttgcagtgagccgagatcgcaccactgcactccagcctgggtgacagagtgagactctgtctcaaaacaaaaaacaaaaaatagccagtgctgttctggatgggtcaacttgatcaataaatcagtgagaaccaagttgagatgaggctctgttacctgcttcagaagagaaagccgccctcactgaccctttgctcatcttctctgtctgtgctttcgtagattgtcctccagtcagtgactacgtggtcctcaacgtcaccagtgacagttttcaagtatcctggcgtttaaattctacacagaaccacactttccatgtccgggtttaccggggtatggagttgctcaggagcgccaggacacagagccaggcactggcagtggctgggctggaggctggagtgctgtacagggtgaagaccagctaccaggggtgcggggccgacgtctccaccacgctgaccatcaaaaccagtaaggcccccagtcagagacccacgttagcttgcgagcttgtctttctatcccaggtctgtggccctagcatgtcgcgttcttcttcctataaccagggcaccagaagtcactgaccgccctgcacttcctccctcccctcccagtcatcccactgcctgcccggcattgcaccggcccgctggtgccttcactggctccctcgcttccctacatgtcgtcctgttaggggttcgttctgccgtgtgaggggacaacatgtggactcagaagcaccaataaggcatcagctagggtgaagcaaaggaacaaaataataataataaagcagaaggcggcagctcctggcaggcagatccggaccctgcccgcttacccagcagcactgaggccgtctaagttccctccccgagaggggagcatcgctgacgttttcacgccttgcttcactcatgatgcatgtaaagcgaatgccatgcccaccacattggtgctgggacaaaacgttttttctttttgagacagggtctcgctctgtcacccaggctggagtgtagtggtatgatcacagctcgctgcggcctcgaccccctggactcaagtgatcctgccacctcagcctccctagtagctgggaccacaggcacacaccaccacaccaggctaaattttttatttttcataaggatggagtcttgccatgttgctcaggctggtgtcaaactcctgggctcaagtgatctcaggaggcaacttttgtctccaaaacacacacgacacacacatgaacttggggcttgtgtcaggaaggcagccggtgtggcccatctgggtctgtcccgggcagcccacttggctctgcccgtgtcttgctccccacttgcctggtgcccgtggtgcctagacttggtcagatgaggcctggctggtggaagttctcccccaggctggcatctgtggctgtggggtgtgaatgtggggttgctggggctccattctggttctgggttccgatgtgtgtccctgacgtagagccagtgggagccctgggctgtgggctttgggcttcatgtctcagcagagcgtacagagcatacaagttgctgcatgaagaccatactggggcctttctcactcacaggggttaatgctagtgacagtgagtggtggtggagaatgaatggcggaatgagcgaccttctgtggctcggccctacacccttttcaaactgatttggggcggacctcaagctaagtcctcatagcagccagcacgggcatccagaaagccctcaagcaccccggccaccctcgacacaagccctccactgtgcacgcggcatcccattccaagctgactccacctcatcttctcatttcatttccaaagtacaccaggactgaggggagggacactcttttccctttttggaaactgaggcctgagaggcagttccattacagaaccatcctccagggtacaaaattgatctctattgggaaatgcaataggaacttgcagctccctccccaccccagcaaccccgtgccctcctcaccctccccaccccagcaaccccatgccctcctcaccctccccaccccaccaaccctgtgccctcctcaccctccccaccccagcaaccccgtgccctcctcaccctccccaccccaccaaccccgtgccctcctcaccctccccaccccaccaaccccgtgccctcctcaccctccccacccaccaaccccatgccctcaccctccctacccaccaaccccgtgccttcaggaaaaaaaatacctgcattccaatgtcaggcacagataatttggaagactctagaagactctagaattaccaacctattccacttcccagccttgattttctttccttttccagattataaaaatgccctttttttgtagagcccttttttaaggagcccaatttgctttaaaggccttgtctaattccaccttgtcatgagcctgtgacaccgggaggcagcagggcaggtgttacggtggcagcggatgcccagagcctccagggagtccaattcccagggccctggaggaggccgccagtccacggggctctgcgatacgtcggggcctgagaatcggaggccacatggagtgctcctccctcttgctaagatgggagattcacaggggccccaactgggaaatatacaatatataacattggtggcatttctgtggccttaagtgtggcgtgcataggtgacacactctgatggcccgtagcttgccagctgggagagagccagggtggggcacagctgcaggtggctgttagataactagagaaacatgcagaattgccgccgacctgctcctgtgcccgccgacgcttgggttgtgcatgctgggtttcctttcagtaatgaaagatgaatattcccgtgtcccatcttgaagcttttttccatctttgcttatgccccaaaataacgcaacctcccttgtaagtaagcaaccctaccattttgactggcagagtacgttcttgagaagttggactttcagagctaaattctggaacctcccgggcaggttggaacccattggtcaccctgatgttgggggcctgagtaagggcctcgtcgtgtgagtacctcctgggccctgtggttgtgaatagggcaaaggaaggcagcagccaccccacgggaaaggaccctccatgctctggttgaatcccagttcccgtgggtatgggctgtgtgtgacgtttgtacctccttcctgggatgtctctgccctggacataaaagtgtttgtttattctctcgtttcttacatttatttcccccaattaggatacctcaatctaagattcatgcctcaatctattaaaaaaaattatcccgccaaagagtaggcttcatggaaaacattaacagacaagtgtgtgacttttgaccacaggctaatttgtttcactgtctgtctcagatgcccaggtatttgaagtcacaataaagattgtaaaccacaacctgacggagaagttactcaaccgcagcagtgtggagtaccaggacttttctagacaactgcttcacgaggtaaagccacaatgcagacagaaatcttttcttgggtgttctgagtgaggacatcaaacacaagccgttaattcctgcccagctcttcctctgggattgtggcaaaaatacatgttactgcagcttcaggggaggccaaacccaaatcgcacagtgattagtcaaaagctttccccctgcttttatggggtacttaatccagatactgggccaatccatctttaagatatgtgcctttattcaaatggtgtacaccacttactcctactgttggattttctgtggaaccttctgtctgagggccctggcttccagctatggggtagcttcattagtgaagcatttaccaacaatcatggcatccattcctccctcgtgactaaagggagacatcagcagacagccagggagaagcaagccagtgggaagcaccatctatccacagatggtgcattggagggagaagtgacttcctaaactgccaagaatcacataaagtctgaggttttaccctccctgcaaactaacaagtgagtctgccacagtttcatggatgctggcagaagacacgagactcctgggccagagacggaagactgtattactccagcacagcaggcagcatgcgtgtgctgctgtgccggttccccttcctgcacccgagtcccgcagaggtgatgcagaggggaccaggggcatgaagcacacaaagtgggtctgcacctgagctgaggaaccccaactctagggaacctgaatcttttataatgggtgcaagcactggctccagaaggagacattatctgttacatcagacagtaacaaacctgccctttgctctggagggagccaatatctctccctcccaaggctgttcactatgcaaacatccttggaaagatattctggaacaaaagggcagttagtgcgtctacttgcaagatgtgtagaaatgccagagacccacagagtgttgcttcccaacatttgcctggaggaggaatctggttttcaatgttttcagagaattccctcccttttgaaatgttaactcacttgtgtgtgcaagtatgggttggcacaaaggcagggaaccaggctggtatctcccttgcttgggcatgggtagccctaagcacctggctctgtgtgcgtgttttgtgtgggatacagcctagtaagaggggggacagctccaaatagccataggcattgttccttggtggggcctctccatctatcaatcaatcagtctttctcacacgctcacacaaatgaccttcgcaccagttttcaggacactcagaggggattgtccatctgatgctccacaactgggagcttgattgcagtggtcactgtgagtccccagcacacaccaggccaggcccggccgtcccagggaaagcccagctaaggtgctgtgaacggacttctctgcgtgctctgagaggtcggtcgtcaggtgcctcctcttgattgtagaggagagaaatggctccaagcaccatccatcggtcacacctggaaccctgcttaatggtcgtgaagacgttgatggatgtctgctgttgcctcttcttggctaggtcgagagctccttcccaccagtggtgtctgacttgtaccgaagtgggaagctgagaatgcagatcgtgtctctccaggcgggaagtgtggtcgtgaggctcaagctcaccgtgcaggaccccgggtttcccatgggcatctccacgctggcccccatactccagcccctgttggcaagcacagtgttccagattgaccggcaggggacacgcgtgcaaggtatggcccagccacccgccctgctgcctggtgtcctccagctcagaaatcctcttggtgactttatttgagtcagtctttcctttatttcaaagggtaaagaaatgcaaatccttattctatcttcctccaccggaaccaggggccagggcagtagccctgaataactagctcacctgtgtctcattggtcagcccaggacactgagtgaaatggggctggaaggtaccctcaggggaaagggacaggagttcactgtgtctgtcgtcagggccccccagcacttctgggcagcgggacaactgcccacctgtgggtctatttcttttctttttttcttttcttttttttctttttcttttcttttctttttttttttaagacagagtttcgctcttgttgcccaggctggagtgcaatggcacgatcttggctcactgcaacctccgcctcctaggttaaagtgattctcctgcctcagcttctccagtagctgggattataggcgcctgccaccacgcctggctaatttttgtattttaagtagagacagggtttcaccgtgttggtcaggctggtctcgaactcctgacctcaggtgatccacctgcctcagcctcccaaggtgctgggattacaggcgtgagccaccgcgcccggcctctgtgggtctatttcattacgctgtgtgttatttcattttacttggtgttgccttgaagcaggaggtcatggacacaggacagacacaaagagacagagagataaagagagagacagaaaggcacggagaccaggttcttgctgtcctgcagcaggcacggagttctctcctggctgtgagggcacacacagtctctagatccacaagctccagttttgggctcaatctgtggagtgggcacctctctggtcgtctcccggggtgctgggtcttggagctcagccacgtgctggcttcctgtcccaaccttcccccaccaggaggtgccgggaagaactgggttgggtgtggggggatctactctttgaagtcatgcctggaaacctcggcctggggttactctgttcacttggcactccctaaggatggggatactacagtggcccctgtacctggtaagatcccacctagctgggctgcagggtagggcctgaggttggggtccacagggtatgcccccagcagggtcctcagtgtgtgaccccgtgatccaaccttcaggcggatccagccttcaggtggatgccacccagcccgccctccacacctccctgcctccctcctcccatcctctgggactagggctcaggcgattccagatccctgccaaatgagaacctcggcagcagggatgtcgtgggtagaatggtggccccctccaaaaagatatgttcacctggaacttcagaatgtgaccttatttagaataagggtgtttgcagacacgattaagttaaggatgtcaagatgaggtcctcctgccgttggatttgggttggcctgaagttcagtgacaagtgttcttatacgagacaagaggaggagacacagacacagaggccaagattggagtgatgcagccacaagccaaaggactcctggagccacaagataagacactggaagaggcctgggaaagcccctttcctagagccccagagggagggcggccctgctgacacctggagtttggacttcgcctccggaacggcgggaatacatctgtgctgtttcaggccccccagctggtgtgtttgtgatggcagccacaggagacccgtgtcttgcacctctaggactggatgaatccattgtaagcattcgcagcaccccactccccacgctgttcagtggtcctgcagaagttattaagctccttctgcaggctcttgcccggcagggtcccgggcaggctgtggcctgcttcctccacatttcagagctgaggtgctggtgcgggcaggtctcctgagctggggggtcagctgtgtggccagtgatggtgacgcctcaggccgtgcatggccggggaggcggccctgcctctgcactcttttgactccatgactactggtgtcttcggacgccagagtcgggggagcaaccatggggcaccgcccctgcctggggaggcagcacgaggcctgagcccagcttacagggggacatccacccccgctgagagccccaccttcacggcgaggatctgtagaagaagacatttgatattactcggcaaaaaaaacaagaaacgaaaacacaaaaagagctcctctgaagaagaaaaggtatttgcgctgtggtccacctagaaataatgttgttggcacaactagagcattcctcagtcattcaggagcactccctgccggtgcgtccacatgtcccaaccccgatagatgaggcgctgttcgcccgtggaggggtcaggttgtcgtgaccttatctttacccttaggccgtccatcccggggcctggggtttcctgcgccagtcacggtgggctgtgtaggtggccatgtgttcggtctttccccaggaggtacgtaccatgtgctgggaggcctggaggctgagccgccccccgcgcctatgagttgcaccctcacagcggcggccaaacctcctgctcactttgccccataggaagaggttagagtgaggcggaacgggttggaatcccagctctgacactcactcactgtgggatgctgcacaaatgacttcctctccctgggcctcagtatactcatctgtggaatgagattacagcaacatcccacctcctatggcgatggagtaaattaaggcacaatgcctgtgtgggtttagcccagtgcctgtgcatggcgacagtgcatttctgatggcccctccagcgttcagggctaactcttccaggattaactttcatatcttggatgagagctcatctaggaaggtctcctagcaacccctgggttcccactggtccttccgcctcacggggctcctttttgaacccctcacatcatttccattcaatctcttgctcctaacagcacggcccctattccttctctttcccaacatctgctctcaggagagattctcatacagtgtgcatttgttctagagtgagggtcatcactgggcttctatgaggcaccgctgtgaaccctctgcaccgaccttagccagaggagcaggactcccaccggcatccttctgcgtaagaggccttgtgggtcttctggggctctggaatcaacgccgcttttcctggggccagagtaggtggagctgagctccccaaagcttccagtttgctgcctgctcccacccgcctcgccactgcgcgagccctttccatcccctctgcagagtgagagaagggccgtgagtgaggatcctggcctagggctgtcaccatccccctcacctgctggccaggctaacctactgcaggctgcttcctttccttaggttcacgggtaccgctatttgtccagcgtccatttgcggtggcattaggatgaggtgctctgtgccctctttctcccagtgtgaatctgacacacgcccccaggagagtccgaggggcatcacttctggaggacgccctgggccctgaaagacagctcatggtccaactgaggagcctgcaccttgctgggacagggtggcccaggagatctggggtctgtacctgctcctggaccctctccagcttgttgttctgggtggggccagctcaggaggggcacctgggctgggagtctctgaagcagctgcccccattgctccaggagagggctcagcccttgtcccagctgcggggccagtgggagcagtgtgcagcgtcctgccctgggctctcgctggctctgcgccctcgcctggccagcccgggagggtgcagaggctcactggcagctcttcctgctcccacacctgcctcttcctctgaactggagggccggcaagcctcaaggcttaatgcaagactaaatacagctgtcagcgccttcctctgagctcgcttgggagctgtctggggggacggaggagtgaagattaggtgaatcaccacgccccaaaatagacatcaggtgcttggtggtttgagccagcgtcttgcctggtgcctctgctgtcctccgtggactgcagcccagccagcctaggctccaaccccaacccggagcacccccaggagagttacctgtaggctggaggttgagtagcaccccaggaagaggtgtgggttggcaccagcagtgttctgatggcaaggcagcccccaggccatgctagggtggtggcatagctgttgtggcagctgacgagcttgctgttctccagggaagctgcttctgtggagaccgcaggaagcacaacagaaaaaaacccacaaaacgagcctcagagcactcagcagcagggttttctttgcccagaactgaactggtcctgcatcgtggcttaaattccacctgaattggaacttctctggcatgccgggtgtgggttcgttcccgagcacctccacccgcagctctacagaagcacgcgcagaaggcactgtcacctccagcagggcctggccctgacgacctcggctcagccaccccatgggagctacattgtccttgtcctcaccttcattcccctcaggcgggccccccggtgacatgacatcacaagtctttgggcacaggaggagggacatacctgtggagacacccgggtgctctagaatatggcgcgggaagttcatgttgtactccgctggaccccacccccggcgtgggaagttcatgttgtactcaggctgacccccaccccccccacgagagaagtccatgttatactcaggctgacccccactcctggcatgtaaagctggtgttatgctcagctggacccccacccccggtgtggaaagctcatgttatactccactggcccccacccccggcgtggaaagctggtgttatactccgctggacccccacccccggcgtggaaagctggtgttatactccgctggacccccaccccccatgcggaaagttcacgttatactcagctgtgtccccacccctggctcagttactttcctatttcttggttgagacactaagtattggagaatgttggcacatcaaagagagaggagaaaacatttcaagttttgggtgtggaaacagaataaagaagagagggctacatgcacacccatgggtgctaatatttaaggaatgaacatttcctaatctttgcccccaaataagccaaccaatgtgaaggtgggcacaggcaggccgtaaggttgtcatgagagtgttggacggatgccccaaaatgcccctgctcccggccgttcactgcaaagacggctaggaaggactccttccagcatgggtctgtcttctgatcactctttggctgttttctcatgggttttgattgtgtctccccctggcagactgggacgagtgtgtggacagcgcggaacacgactgctcaccggctgcctggtgcatcaacctggagggctcctacacctgccagtgccgtaccaccagggacgccaccccctcccgcgcaggccgggcctgtgagggtacgtgtcgacccccctgccgactctgggaagaccccctgcccgagaatctgggggtggggcaaagcccaattctccataggcacagggctgaggacctatggtaatgttaggggcctacagaaatgttttcatttcaatttattttaaaatcagaagaaagaaattaatagaaggatagtaaatatacataaaacaatgaatctagcttggattacactcatctctatctaaatgccattataaaatgtaatttttgatagattgttaagtggaggggtgcaggggtccatgaaggccaagttccttgggcccacagaagtcaggatgcagcccggggtcgagggattccttccccagtggcctggagcccgagagggtgtggcctggagcccgagacagtgtggaagcccagagaagctgcagagaggcccgatgggggccgctgagctctagtcctgctgtatcggcccccagtcttttctgtggaccagttctgatgagtgggtcggggatacctgggatgctgaattgagcagcaggaggaggccacgtagggacctaaaatgcagtgactgattagcaatgtcggcccggacacaggcgtggcagaggcgcccagccactggcttgccagcccctgctgagggctttctagctggaaggagcagccgagaccagttccctggggagaatattccttagacactgcgtgtgctgtcctgcttcctaacatcccacaccttgtcttctgtttttctcattcgcctaatgtcctgcaagtcgatgacagcatccagcaccaagtcccacattgagcacaaatctgggggaaattgtcccattttcccagagtcctgatggattaatctgaggcctatgagaaccaagccctgcattcaagcccgggttttgtagccccccgggtggatccctcaccctcaacttcagtttcctcatttatccagtggagaggcgtgatttgccttcagagagccccggggaggctgcaaacatgggcccaggaaacactcctgaacgctggcgcccgcctgcgtccctggccaggtccactccgggatgcagagcagtcctgctggacggccatgctgccctcctgggagggctcttactcgtgggtgggatccagcaggctctgacagtggatgtgtcttggcaggtgacctggtgagccccatgggcggtggactgtctgcggcaacaggggtaacggtcccaggtcttggcacgggaacagcagccctcggcctagagaacttcaccttgtcacccagtcctgggtaccctcagggcaccccggcagcaggccaggcctggaccccagagccctcacccagaagagggggcagcaatgtggtcgggtatgacaggaacaacacaggaaaaggcgtggagcaggaggtgcccagcactgccccgggtctggggatggaccaggggagccccagccaggtgaaccccagccaggggagccccagccaggggagcctcagacaggagagtaccagccaggcgagccccagccagaggagcaccagccaggggagccccagccaggtgaaccccagccagcggagcaccagccacgcgaactccagccaggggagccccagccaggggagccccagccaggagagccccagccaggggagcaccagccaggcgagccccagccataggaacactatcggggtgataggcaccacctcctccccgaaggctactgggtcaacccacagcttccctcctggggccacagatggcccactggccctccctggacagctacagggaaactccatcatggagccaccctcctggccttcccctactgaggaccccaccggccacttcctgtggcatgccacccgttccacccgggaaacacttctgaatcccacgtggctgcgaaatgaggacagtggaccctccggttctgtagacctgccattgacctccaccctcacagctctgaagacccccgcctgtggtgagttcctcgaatggtgcatggggactaggactaataggacccatagcctgtgtgagcctctggggcaaagctcctgcagccgtggagtcgcaggctgctagcaatgctcaggcggcatcctcatcttgtgcgtgtggaaacggaggcacccagcagctggtttctagttgagttaggaagacagcttggtccccttgcctgtcccagatctctcttccccatctcttagggctccctgtctgcagcagctggggcggaggtctgccttcaggagcaggctttgggccttacttgtcgcgttaggtgctggagccatcccctgaggtgttgcccacccccgctgtcctgcctcctagcagaactgtgtcccggccccgatcagtgtgatgacacccccacaacaactctgcaccctcccagtaatgctgcactcccatagctgttctgcacccctcagctgttccgtcaccctgccaagcattctgcagccctgcagctgctctgcacaccaaggtgtgctgcaccccagcttttctgcacccccggctcttctgtactcccagctgttctgcacctccccagctgttctgtatctccccagctgctctgtatctgcctagctgttctatatgccccagagattctgcatttccccagctgttctgcacccccagttgttctgcatctccccagttcttctgcacccccagctgttctgcatccccagctgttctgtatctgcccagctgctctgtatctccccagctgctctgtatctgtccagctgttctatatgccccagagattctgtatctccccagctgttctgcacccccagctgttctgtacccccagctgttttgtacctcccagctcttctgtatctccccagctcttctgtatctccccactgttctgcacctccataggtgttctgcacctccccagctgttttgtgccccctcagctgttctgcacccacagttctgtagttccccagctgttcttcaccccagatattgaacctctgcagatgctctggattgtcagctgttccgtacccccagttgtttttttaccccctaagtgttctgtacccccatctgctctacacatccagagttcctgcaccccccagctgttatgcacctctagtcataccgtaacccccagcaattccatgttacttgtagaagatttagccatcaccaaacccccaggtgacatctcaggagattcacagcaggaatctgtgcaggagttggatctcagccgtgacagccctgtgagcttgcagagctagcctgcctctggatttcatccaaatgagctgtcaaatgtgatcttcctcaatgcatttcctctgctaagcagcacaggctctaagactaaactcttagcccatgtaagtcagtattaccgagggacctggggtcttcctgtaagaatggctctctagccagcattgtcaccaatgtcaactcctagttggaccctgggtaaatccacccaggggtcaagagtagacagtccatctgaggcgccaccaagaacctgctcaagaggccttcattttggggagtccaggggcctcagggatgtatatgaaccatctgctgaaacaaaacaaaatcagaagccatttgctatcatcccaaggaggggcaaggatgcaggcccaggaagcccgggcttgggaggtttgtacaggatcctactcacccatcacctcggcggccatcacctgcaaatcgctcatgtccccatggtgatgaatttgatttttggcattgggcgaggcttcttttctcctagaaatggcttgattgtaattttggtgtttatattccacttcccagttcctgtctccattgggaggatcatggtctccaatgtgaccagcaccggcttccacctggcatgggaggcggatcttgctatggactccaccttccagctcactctgacttccatgtggagccctgctgtggtcctagagacctggaacacgagtgtgacactgtcggggctggagcctggggtcttgcacctggttgagatcatggccaaagcatgtgggaaagaaggtgccagagctcatctgaaagtgaggacaggtaatgggcttccatttgtttttaaagagaggaacaaaaagtatgaaaaagactttctgtgggttaaggcttaagagagctggatttgtttatgggctgctaggtgtcattgttcttctcagcttagggacatccggctggcttcagcaggcgtgcaatgacggccagacaggaggtggcttattcaggaaaaggcattaggcagcccacgggtatggaggcggcagcagagtgccatagactgcgcctggaaggctgcgggtgcggctcacccatgtcctccgggggaggcagcatggaaaatgcatgcggtgctcatctgttgagctgcatccactccctctgatctcaacagtcctacagaggacttggctttcaggaaggacatcaacagacaatcggcagtcacatggatgatctgtgagcagcctgccagagcctggggccacaaagtaaagaattgagcaataatgaatcaaacatagactccactgcgttccagctggacagtgacaatattacacatatttggatgaaattcctcttttcttttcattagcatcgctacctgggtattttcttatgtgtaccttacctgggtagtcaagagcgtgtctgatgttgcaagctggttttcacgccatgggcagcttcccaagcgttgatagcagtggtctgcacggtggggcgcacaccccttgagggaggtgtaggatggtttcacactgtgggcagcattgatagcagtggtctgcacagtggggcgcacaccccttgagagaggcataagatggtctattgggatgcaataatagaagttgagaactatgtatgtgctttaaagtactaatcagccatggcctgagaaattagagaacagatggagtgcatgacgtgaattgtgcacgttcacgagcagctggagaggagggagatcagtgctggctggacagtcagacagggtggctctggggtctgagagccagagttgggcctctgaaggtctcagctgctctggacgggacaggctgcacgggggaccccaaacctgtgggtgcacttatacctgctctcacctgtgcacctgtcctgctactgatggctttcagactgggttgctcatgccagccatggagactgaaccagaagccctcaggggcagcaacaacaatgatctcaaggacgtagagtttggggttcgcccaggaatgcatagcagaatggctctgtggtttgtcttaaacttagtgagaagctctggggagatggactctaagccccctgaggggagagctgtgtctttctccttcactgtctagaatgcctctggcgcatggcaggcgctttgcaaatatctggtgagggactgactgaacactggggtggctgccatgccagggccaggatgggatggcgacattcctggaccacatttatgtgccacatactcctagaagccctctgcggagggaaaagattcagatggaacagatgatgccaaaacagggactgcccatagaccaggggaggtggggctgctgggggaggaagaaggactggctccaaacaagacccctgggcaccctgtggccacgtggactctgagcagaggcctggccagggccctaagtcctgttatacctgggacagcccagtttgcacccgtagccctggcaaagttatttaatggtgcctccacatgcttcaagtcatgccagcttgctgggaaattgtctgaaccccagcatgggggaacggcagcaaggaaggaaggctatgtgtggtggggagacagttgcaggggcgagctggctctgtggcctctggaaggttctcccactgtgttcaggctgtgttctgtgtcctctggaatctgatgggctgtgtccctgagccctggcactattccttctttctagaacacgggttggctttggtgtgatgctcttcctggacatgaaaatacatttattaatattgaaatgttagtctgttatctaatacagcaccaattccaaatgtgcttatcctccatcctgcagcagcccggaagctcattggaaaggtcagaatcaaaaatgtcaggtactcagaatcctttcgcaacgcaagcagccaggagtatcgagatttcctagaactattcttcaggatggtgagttggtgatatcagcccttaattcctttcaggagggaaagggtggaaggctgatagaattctaggttaggcacggtggctcacccctgtaatcctagcactttgggaggcagaggcgggcagattgcctgagctcaggagttcaagaccagcctgggcaacatggcaaaaccccatctccaccaaaaaaaaaaaaaaaaaaaaaaatacaaaaaatgagcctgtcatggtggcgcatgtttgtgacctcagctactcagcaggctaaggcaggagaatctcttgaacccaggaggcagaggttgcagtaagccgagatcgtgccactgcactctagcctggacaacagagtgaaaccctgtgggaaaaaaaaaaaaagaattctagtctcatccaactaggaatttgacctataggtcctatgagctcctcatttctgaaggaagccaggacgttaagctctggcctgactccctgagtgtccctggatctgccccggcgaagacacggttagcagacaggaggcacaactcttcctctgctgcatccttacttcacacttcactttctgtccagtgaaacctgtttttcagttgtggaacctatgaagcagaaagtccctccacggttttttttttttaaacctgtaaaaaatgagatttatttcacagaccataaaatctacttttaaactgtacaattcagtggtttagactattttgcaaaattgtgcaaccatcactactaattccagaacattttcatcacccaaaaagaaaccttatacccattagaagtcactcgcagctgggcatggtggctcatgtctataatcctagcactttgggaggctgaggtgggtggatcgcctgaggtcaggagttctagactagcctggccaacatggcgaaaccccatctctactaaaaatacaaaaattagccggatgtggtggcgggtgcctgtaatccgaggtactcaggaggctgaggcaggagaatcgcttgaaaccaggaggcagaggttgcagtgagctgagatcttgccactgcactccagcctaggtgacagagcaagaccccatctcaaaaacagaaaaaaaaaagtcactccctctcgccacttcctccagctcctggtaatcacttatctgctttttgtctctatagatttgcccattgtggacatttcacagaaacagaatcatacaatatgtgactttttgtgtctggcttctttcagttaaaatgaggttttctggtttcatccacgtggcagcatgtgtcagcactggattccttgttatggctggggcataacccatgcagtctcatccattcattcaccgagcgcactgggcggctcccgccttctgtctgttataaatagtgctgcaatgcccctgcctcagagaaagttcttttcctgctctttcctgcattcctccctgccatcccctcagcattctccaggatgctatctgttaccatttagtgacatgccttcttgtggactttttgaggtatagggagtgcccttgtcataatctagtgattttgtttgcacggaatctcacattgtagatttcctgagtctgagctcagcacagagagggtttgacattgccacctagtggcctgtcgtggtaataccgtagcagggctgcaaaccccagcgcttcccccacagatgagaagattcgacagcctttgggaacggcctagctcattccctgctcctggtttgtgcattcaacagttgttgacggtttgattaataatgtgatttcattgataaggttaaatagtagttagaatattaaacaacaaacactgaatccttccacctggctcgagtggtcaaaagaggcagctccgtttccttcccgagtttcttgattaatctttcctctttgaaccatttcttcctttgcccatttttggggtgttgtttttctgtttgcctagaatttcaggacagcaaataattatacaacttaatcacagaagtaggatgttaagagaaatttcgggggtttcacttgctgataaccgcagacgtggatgtcaggaggtgttggctgcatggcttggtccctggctcttcaccacttcctagcaaggggcctggaagtttgcttagaggttggtttgaaatgcagctaaaagtcacattaatccaagactatgccagattcctctgagagaaagagagagggaagaactgattgtgaagatggtcacgacaacagtcatctactgagccaaccaagggcagctgtggtctccctggggtccacaggctctgagagggacaatggatctgttcaccttggtggcccagaagccgggaagtgagtccatgacccaggccttgagccatcgcacctgtgaggacaaaccctggaagtacccataggaggtttgcactgaggatgattgaagctcattataagattgtttgcctttctgagtgctttgaccatgatgggttagcatggaatcaatcatatagcgtgtggtgtgtgactgtgtccaaagagacagagtagaaagcagggcgttcgggggcaggaaccccctgtcctaatggggaagttggaaatgctcacaggaagcagtctggggagaggtagggaggaagaatgaaaggggacatgttctgcagtgccaggagcaaaagagctgttccagagaaggcagcgggaagtggtctccctccccacgaccctgcactcagccccctgccctcggtggctgcaaaccaggagtattaggttctagaagcccttgtgagcccccagcaaattttaagccccatgaggtagggtctctgcctgtgcccccaagtcccaccctcgccccacaggcatctttctgaagccgtttactggtttggggggggaaacaagggctcttctcatatcacagacactcccaggcgtttgtgctgggcttgaaaacacagcagacaggaaaggggcccagaaccaacctgtggcttttactttgtgccacgggccagccctgctgctgggcagactggcaggaggaaccgccttgagacgggcatctgtttcctctcagcgtggggacctcctcacatggcctctttccccgcaggtgcggggctccctgccagccaccatgtgtcagcacatggacgctggtggggtcaggatggaagtcgtcagcgtcaccaacggcagcatcgtggtggagtttcacttgctgataatcgcagatgtggatgtccaggaggtgtcagctgcatttctcaccgccttccagaccgtgcctctgctggaggtgatcagaggcgacaccttcatacagggtacgagaggctgggatggagcctctcccgtgttctggaaccagaggcagccagagggcagccaccacccttcgcttttgaaagatgtcgtgttgtgcccatgtggtccttcttcccccagaattagatgaagatgtgaaatagataggaccctgtctgtccctcttattgtgattataattgtgtaaaggttgaagtgttgaaaacatctttgggtgaacctgcagatccccaggggtgctgctttctttccgggtcgactgccccctcgctgcttgtttccatgggctgagggcagatgcatccctctctgcagccagactctcccccaagcatagttcccaaggagatcccagtaaagataattaacgagaaaagcagggagaaaaagacaattcagattcttttctcctatcatacttgaacataaatgatgaatggcttatagttacatgtatcagaaacaaaagactttttaaaaattggagattcatattaattttttgatttttagaataagaaggacttcctaaagaaaatacgatttttagaggaaaacgatgagatgctgactgcatgcagagataaatcaaaataaaggcaccattttaacgcaaagtaaacaaaaaatttttcaataatttggtgaagtgttagtatcccaaatatatagagagatcatacaaatagataaatattaagaacctgatggataaatgcacgaaagctctacacagacaaggtataaaagaagaaatatgaatgactaacaaagatgtggtaacccaagacatccccattagaatgcattgcactgtttgcccatcaaattgcaaacaaaaggtctctttactgctgacatgaatactggtgaaagtgtagtgaggcaggtgtttgcacagattgctggtggcagaaggatttgctcatgcttcctggaaaccagtttggtgacataaatcaaacgctttcaaagtggccatccacttggattctgaaatatcagctctacgactttgtcctaaggaatttgatctgtttggaccgtagtttaaatacaaagatgttcatcttcagtgttactttaaaagccaaagagttggaaatcaccaatcatccagtaacaaagaaggtgctaagttaccaggtgtccccgccccgggctgttatgcaatgatgagaatagcggtttgtggatttgcatggagctagttggtggcagaggcaagctatgctctcagagcatgcctgcattttaaaaggctggaaggaaatacgtccacatgctaacttgcccctggccacgcttttctggttcttatccatgttctgcagtaaacctgttttgctgtcaacaatcaacccagcatcatggcgaaaggcaaatggcctgagggccttctgcccagggttgggcttgcagcctgggtcccttgggctggaccgaggtggatctgggggcctgtgcatctcctggttactcccgggaactgaagggatggccctgctctgcccagatccccctcccagccctgggccagaatcctccttccagaacagcccctgcagacatacttagccattcccagccccagcttcaggaagcctcctgtactttccagaactggtgagcttgactgcagtctgctgtggctggagtttccagctttgtctgtgagatgcactctcccccaaccaggctgctgtgagaccacaagcccccagggatgttcttctgttttgtcttctaaatgttgtgcagattacgatgagtgtgaaaggaaggaggacgactgtgtgccggggacatcctgtcgaaacaccctcgggtctttcacttgtagctgcgagggaggagcccccgacttccctgtggaatattctgagagaccctgtgaaggtaatgtcgtcagagtttcttcttctggaatactgtatcataatcggttttttttaaggacattcacgtgcaaagggcttcttgtccctctgaggtcatatttttatgtcctggggaagtttcctgtgtgtgatgtgggtgcacgtgtgtgtgtgtgtgtgtgatgtatgtgtacatgtgtgtacgtgtgtgcatgttccttcccattctttcatatgtgtccaggcttctgggcagtgccttatctctccaagtgctagctctgatatccatggagagaaaatatacacatacatgaggtgtgaacgtgcagatgctgagcgaccgtcttgtgaaacacgcagccgtgggacacgcgacacaggggaatgtttcctcttggccactctttccacccagctcttttcctgctaaacggggtcttagtggatttaacactgaccccacgttggccactgctatccaggaatctgcgtcaagtgaagggaggtgggcatttataccagtgagtgtggtatccggggggctatagaacgtgtcctgcttgaggtagaatcaggaagcacagaggaggctaagttgcttcagtccagtgagtgtggccagggagggcttcctggaagtggtgtcttgaagctggtcttaatggatagctaagatggcacccagcagggagggcagggcatggtgggtgggtgccgtggtgagaacagagctggtgatgggcgtgatctcacatgcagggacctgcaggagatgggtggcagagagcgagaagcaggctgcccagggaggcgggtgaggcagcagccaactgtgaagtcctcagcaatggtttggactatggcccagagacaggagtgagctgggtggagctgcagggtgctggggctgggcaagccccactctgagataaaagaaggcacaaaccaggcccacagatgatggagccactgctgaaggagggtggagggcacgtgcggagctgtgtctggggtctgcttccatatagaccaccccgagaacaggtgggtggattggaaagctttccgggccccttgttctcctaggcattgaaactgaacctgctctgggggcaagaagggagctggagtgggaagtttgggcacaaggacctcaagaggaggcatcattaccccatcttagagaatagactcagggctctcagggcagaagactcaccctgtatccactggcttggcacatccccggcatcaggtccctcggtccttggccctcgggggcccatggtgagcctggatccctgagctggtggaaatgtgcaacatgtgcatgtgtgcgtgtgtgtgtgtctgcacgtgtgtgcgtgcgtgtgtgcatgtgtgtgcatgtgtgtgcatctctgcgtgcatgtgtgtgcatgcacgtgtgtgtacgtgtgtgtgcatatgtgtgcgtgtgtgtgtgtgtgtgtgcacgtgtgtagttgtggctggaacatgcggttcccaggtgtggctgctgcagagtgcagggcagctccagtctgctccttacccctgcccctccatgccaaccccaaacacagagccactctttgccttttcctccttgtgccttgcaggtgactctcctggcaatgaaacctgggccaccagcccagagaggcctctcaccacagcagggaccaaggctgcctttgtgcaaggcaccagccccaccccccaaggcctgccccagcggctgaacctgaccggagcagtcagggtgctctgtgagatcgagaaggtggttgtcgccatccagaagcgcttcctgcagcaggaatccatccccgagtcctcgttgtacctcagccacccctcctgcaacgtgagccacagcaatggcacacacgtgctcctggaggccggctggagcgagtgtgggaccctcatgcagagcgtaagaccaggagagccaggctcaggatgtacactagggcgcaaggggctctaggttacatgggcctcgatgtgggagggccaggcaagactctgcaccccgaggggaacccagcaaggggggttcaggacagggttgagttctcaaccagggaccagcctgcaccccagaatcggaagggagctgtgagtccacccaggagggactctggtgcagagtgctggggcaggcttcagagtcacggcttaaaactcctccctgcacagacaggatgagaggcagtgggacaggaagaggcaggaaagccaaggagtcctgtgtgatatgagagtgtgtgtgtgtgagtgtacgtgtgtgcatgtgtgcatgtgtctgaatatgtctgtgtatgtgggggtgtgcatgtgtgtgaatgtgtgtaaatgtgtgaatctgtgtgtgcgaatgtgtatgtgtatatgcatggctgtgcttatatgtacgtgcgtgtgtgtgtgcatgtgtatcgcgtgcttgtgtgcgtgtgggtgtgcatgcatgtatgaatgtgtgagtgtgtgaatgtgagaatgtgtctatgtgcatgtgtgcatgtgtgcgtgagttgagcatgtgtggatgcgtttgtccatgtgtgagtgtgtatgtatgggtgtgtgtttggggggcattggatggcattagtcagaactgctctgtcggagggactgtgttcctagcgaacattctctatttcagggtcctggatgggctgtggggctcccgggacagagggagcccaggtggggaaagtgggttttcctggcctgaggccttcgcacctctgtgtgcacagatgggctctggcacctccccttgcaggtgactctgggccagtgcgtcctgggtctactctgagcctctagtgtgtggcacccatgaggtagctgacctggctccaggtcctgcttcttcccagggtgcctctgtgtcacagcgaacgctcccatgcaggcccttgttcgtctccaaccccacttggccacatggagcacaaaggcttcgtgttcagggccctgcttgggggacaagaggaggggagagccagcaccttccaccagctcagcctggtactggacacaggggcctgggccgcatgggcctgggagtgcagggtggatcagggaagctgcctggaggggccggcggcttcagagggagcccgtgccggctctgggttggggaagtggccttctgggaaggggctcgacctagaaaggaggccagcgtcgttccaagggtgagtgagagagctgtgaatgtatccaagggccatgccgggggtggctagatgagggaggctggaaaccatggcggagttaagagtctgtccgagtggttctggtcaggtgggcagggatggaagggtggacactcatgggcagggtggggtatgaggcctggtgggaaagtggggctgtggatggggctgagcagggagcagtgcctggcctaggagccagggccagaaggctctcctaatggggacattgtcctcatcgggagctaggcaggaatggtggttcctggtcgttggcgggaactctgggccctgggcttctgtccctcaggacctttgagcagtccaaggcattgcattctaaaaaaagggattggttggggtggtgccctgaaaccaccgtggacctgcttggctgagagttctacatgcatgatgatgtttagtcccttagcgaccgcatgggtcaggcatcatcatccacgctctgcggctgagccctgggtgctcggcagggtccatgggagttcagggtcaaagtcaacctgacaccgagaagcagccccgtccctgtggctctgcctcttgaggagccttgagggggtgctgcttctggttgggggtctggacacactccttagtggggacagggcggcctctggcactggatgggtcaaagctgtcagatgaaacccagagtcctggcatggggtgtcaatgtctgggagccgacaaagtgggaaccgggtggacgtcctgagcaggaggctgggacatggaccttggggctgagtaaggagctagccctggggagcagaggccagaaagccccaggggctgagggatgaggtggggaggtggggcataaggtgattccatggtgtggagcctgcttggagcctggagctgggactgagggtggccaggaagctgagggattcacgtggacgcgtcggaggccattgcagagcacaagcttgcctgggaggcacagctcactctgccgagctcattccgccccctcgggggctcttcagatcctccctgggctgaaggagtaacctgcactgtttcaacagctacaaaaccttcctcacccttcagcccctcaaatggcacaacttaagcagaactgcccagaattagttttctccctcaaagcttcttagacggccacctggaggccgagcgttggcagcaggggggtgtctgcaagggggatgggcggtgatcagtggctcctgtggcttctcggcagtttccctggtgagggaggtctggggtgagaggtgcatgtgggccgggccacagcggcatcctcaagcctatgcagggctcttgcagggctgcggggccaagtggaggggctgagggtgcaggacagcctgcctggtgctcagatcgccacccacacagcggcagctccagtggagagacagcgcctcccaggactggggccctgggcagagcctgcagccggcagctccctctgtgtttttctgaaccagaccaatgcttggcttgattattaaatgcagcagggtttggggcatgttgaaagaaaagggaatttgtctctgatgactcacccagtccctgaaatccacaagagctcttgacggtttttgacacttgtcaaaaactaagtttcccagaaagacttatttgtgcagctgccacggaatccccacaggttcaggtgctgcctcctctggtcaatagggaatgagcagaggccgagcccttaggctcttaggcagtttatggttgggagaatcgccaggatctcgatgctgctggggagaggctttagagaagaacccccatccccccagcacctagagccgtggcccacagcagggcgtggggggccggctggggcctgggagctcctcatgctccgctttgtgctcagaacatgacgaacaccgtggtgaggaccacgctgaggaacgacctgtcccaggagggcatcatccaccacctgaagatcctgagccccatctactgcgccttccagaatgacctgctgacatcctccggcttcaccctggagtgggggtaagggagaaatgccccggctgccccacagccacgtgcctccagaccacctgcgctttgagagttctttagggtgtcaaccacttaaggacccttccttgagatggaatatacaaatgggtgtggcctggctgctccccaaattttgttccctcttcccactcagggctagccagagaaggccaaatatgtcccgtggccaatcccatgggatggccccacttccagtgagccactggcaggccgccacccaagcctccatcaggcaccactttttctataatggaccccccaccttccactgagtctccacctatacaactgagggaggcaacccctggaccagccagccctgaataaatggcctccaagtgctctcgtttggggttgagggggtcttctcgttcatttgcacgttcctctggagctgtgttttaggggagaagtgggaatgggaggggccacgataatgcgcctcctgaaacatgcctcctgcaagctgcttcctcttgcagggtttacaccatcatcgaggacctccacggcgctgggaattttgttaccgaaatgcagttgtttatcggagactctcccatacctcagaattatagcgtgtctgccagtgacgatgtcaggatcgaagtggggctctacaggcagaaaagcaacctcaaggtggtcctgacggagtgctgggcaaccccgtctagcaacgcccgggaccccatcaccttcagcttcattaacaacaggtagggctcaggagtgcaggcacccccatccagcaatgcctggggctttattaacaataggtagggctcaagaatgcagacatccccatccagcaatgcccagggcttcattaacaataggtagggctcaggagtgcaggcacccctgtccagcaatgcccagggcttcattaagaacaggtagggctcaagcaggcactgccattgcctggccttgctgtgtggccagctctgggctctgcaggatttccaggcgagtgctgtcatggacctgggttttggggaacaaatgaggtgcccggtcctcgacttccacggagcctgtggaatctgcgagtgtcgtcagatgtagtcgtgagtaaactcatctgagaacaaggacagcggggctcgctgacaagcaaggagtcccatttcctctcttctcagctgccctgtgcccaacacatacaccaacgtgattgagaacggcaactccaataaggcccagttcaagctgaggatcttttcctttatcaacgactccatcgtctacctgcactgcaaactccgcgtctgcatggaatcccccggagccacgtgcaaaatcgtaagtgttttttggttttctaaacgtttggttggattcacgttccttattgttacggttcgaggctctgttaataaaaacctagggctcgagtggctcggggccaacctctgggaggagtcgctgtgcctgtcctgcagactccgcgtctgaaatggtatttccacggcaggcagcccttggacggaggactcatgtggactggtgggcatttcccatttctcaatggctgagctgagttccttcttgaggccataatattcaaccggctgtcgcgtcagcactgccttgccatgatacctagtgcttctaaggtgatttataggtgtaaaaatattttttaaatattatttttaacaacattgatggaacatactaaatatcagacactctgttatttaataaagttttttcccctttcctttgttcaacaatcatgcagggataattttacattcctgttttccttagatttttgaatttgaaatatgctttgtaatcctgaggtttgaaaactgtgctttatatcacagacaagtacatgaggttcccacatgttggtcgcctgttgtctgaggcaggggacagcttagggagctccgctgctttttgctcagtgaccgaatgcttctctctcctcggaggtagtgcttgttcctgctctcatctgagctgttttcctgggtgaccaagctctgagcgtctgcaggacgtggatagagaagcaacacaaggaaggctgattctgttcatgtctgttttgctcaaacactagatcttcctgagcaatgggacagaaggaacctcaggtcctaatgacagcaggctgagggccacacacgaggagcctgcccctggttccactggagcctcagagatgacaggagcacggacagccaccgccaggcttcgtctctgcagggagcggctggctctcaagttctctacaagagaattctttacaagaggagcggcacacagtgtgtttttcaagctcctttaggatggatagatagtgtatgagctttccgggctgctgtaggaacgtaccacaaactgagcggcttaaacagtggaaacttattgtctctgttctggaggcaggaagtccaagatggaggtgtcagccggctggttccctctgagagttctaaaggaaggatctgtcccaggcctctctcccagcttctggtggcctcgggcgttccttggctggtagacggcatttgccctgtctctcggtgttgccttccctcagtacacatctatgtttgtgtccaaatttcccctttacagagggacaccagccatagtggattagggcccaccctgatgacctcagcttgatgatctgtttccaagtaaggtcacatgcacaggtgctgggatttaggacttcaatccctttttggaggacatgttgcagcccatctcaggcatctagtgagcagatcccaccatgtcactgagccaggcagtcttttttgtaaggcaaaggtgtaaaggggaacaaatggctgcagcaacctttggagaacacagagggactctgagggctgtgaccaagacacagtcctcaagggacccaaggaagcagctctagcaaccaaaagcagctcaaggggtcttctccagcctgctgctcttgcagacctcacttccttccccgctgacgcctgggcctgcctcttgttgcaccaggacccaccaccctggtctcaccaggtctcccactcctctgtctaaactcagcccccttgccttgcaacttctagcaggataaaatcgcatacatcacattagcatccttgatagtagctcctttctcataaatgttgttcaattaatttgacgtttctcttcttggaaaaaaaaaaacagaattgcaataactttcggttgctgcaaaatagtgaaacctctgccacacaccagatgtcctggggacccctcatccggtctgaaggtgagttgatgacttggtttagacaatgaaagaaaagatgcaaccgattccttttcaccagcatgtaaataaaaaagtaactgttgtgaaatgcagaactcttgagagacttctaagaggcttatcataacagaaatactcatagttagtattcactgagagctgctacgtgtcagcctggcactaagttctttacatgcagaatgtaatatgctcctctcagcaaccctatggagcatgagctattaccatacccatgctacagatgaaaagactgaggcttcaagaggccaggcacaaagttacataatgaaatgttttgagctgcataatatcaagctggtgaagttttctgacactgggtaaatacatccagtgggctgttaagagataagaactcaagctataatcaggccatgtcaacgtgtgtgtgtgtgtgtgtgtgtgtgcgtgcacacgaatgtgcatgcacaaggaaaagctattttattcaaaagatgcaaaaaatggcatatctgttccccctcagtttaaaacttccattagccaattacattgcatgtattttcaaaaccccacatcaactttccagaaaaacattttattttctatatggtccatcatcttattttgaaaaaaaaatacattggtttggggaaaattgtgtgctttgggtattaagagagaaaccgctagttgtcccgtagtatctgttctcctcccctttcatagaaatagcgtccccaggttttgctggtacatggctgccaggaataaaaactgtaattccaacctcctggcagctaagtgtggccatgtaagttctgaccaatgacacgtaagtggaaaagtcatgtgacaacttttagaggtgcaccctccttaaaagacgtctgtgcctaccctctgcctctttcttctttagggctgtggggcccagtccttggagggatctggcttcccaggacaccatgggcaagtggccaaggcaggcctgggttctgacctccacttttttttttttttttttgagacggagtttttctctgtcgcccaggctggagtgcagtggtgcgatctcagctcactgcaagctctgcctcctgggttcacaccattctcctgcttcctactcagtcccgagtaacagggactatgggcacccaccgccacgcccggctaattttttgtatctttagtagagacggagtttcactgtgttagccaggatggtctcgatctcctgacctcatgatttgcccacctcggcctcccaaagtgctaggattacaggcatgagccactgctcccggactgactcccacttttatgacagaaggaaagaaacttccatgtcctttaagccactgctattttgatttttttctcttgcttgctgctgagcctaatcctagttggttttcctttttttgttgtttttttccctaatcttgatgaccctctcccttctctgtctttccctgtatgagaacttctggggtttggatgcagggtgtgagccagaatctgaatgctgctcaggtcttggccatgaagctggggaacaggaggagggaggtctcggccatgaagctggggaacaggaggagggaggtctcggccatgaagctggggaacaggaggagggaggtctcagccatgaagctggggaacaggaggagggaggtctcagccatgaagctggggaacaggaggagggaggtctcggccatgaagctggggaacaggaggagggaggtctcggccatgaagctggggagcaggaggagggaggtctcggccatgaagctggggaacaggaggagggaggtcttggccatgaagctggggaacaggagggaggtcttggccagtgactcaactgctggttctcatttaaagcatttgggaaactaaaaaagtagacacaggtcccaggccacaccccaggcctacacacagaatctctagagttgggtcccaggcccctgagctggtcatcaggtgactgttggtcaaggtgctgggacaacctgcttctcctcactcttcattttcttaatttcctgggaagaacgggtcagcctatttctttcaccctataagaaatagcatatgtgtgaaatatgttctcattaatagataatgtgttctttcatgaatagaaattaaacttcctccttcattcattgatatcatagggaatgtcatgactagggggtgaaaagcactagacttggacttgggacacctgaatttgattataggctctgacacttatgagctgtatggttcatccatcatccacccatacatctatctcatctttccatctatcatttttccgtccatccatccatctacccattcattcatctatccatctatcatccatccatccattcatccctccactcatctatcatccatccatccatctatccattggtcatccatctatccacccattcattcatctattcatctatcatccatccatccatgcactcatctatcatccatccatccatgtatccattgttcatccatccatccacccattccttcatccatctatcaaccatccatcatccatccatccactcatccaaccatacattcatctgtcatccatccatccattcaactatcatccatctatccaccatcatccatctatcatcatccattcgtccatctatcattcatccttctgtcatcccttcattcatccatccatccatctattcatccatccatcctccatcatccatccatctgttcattaatccatccacccacccatccatccatctatccatccacccatttattcattaattcattcatctactatgtttcagatactctgatttttctttgcaacatgccctccctacctcataaggttgttgtgagtgtctaatggtaactaagaattctttgtgaggctaagatttgtgaggttgaaactaggctccctggattcacaacttggctctggcacttaataattttgtggctttgtgcatgctgcatatgaattgtgccttattttcctcatctttgaaaagggaataataataattcctacttcataaagagcctggcccatagaagttattgaataagtgctacttttcacttgtaaccagtagagcactacactggcataaccaaagcaggaagcacggaatgtaataagggtgtaatttctcacgttcaagaacaaggactgtaaatattcatgttgttcaacattctttctcattgtgttagtagcttttgtttgatctatgactatcatacaaatacacagcaaaatcatttagacacatggaatctcccagttggtggggacttggctgcattttaatagtgtatattaacagaaacactgttggagactgcagagatgagaggaggctggcagacaggttcctcaggacctcaccgctatccgcggcctctgagatcccacgctctgtccctgccatcaccatcacctccgtttcagggaagaaatgagaacaactcagagattttagggaatgtgcctaagctcacacagctggtacctgcacgagctgggcctgcgagtgcagatccaggctgctcataacccactctcctctctctgtctcctggggactgagctggcttcattttgaggcttccctccaccccagccctcacatcacactcacgatgtcttggcaccaccacaacaaagtcccacagcctgggtggcttgaacaacagaaatctgttctctctcagttctggaggccagaagtccaaaatcaaggtgctggcaaagccacagtctctcgcaacattgtagggccaagtcctcccttgccgcttcctcgtttctgctggatgtgcccaatctttggtggaccttggcttgcagctgcctccctccagtctctgcccccgtctgcacatggccttctttttataaggacaccagtcatgttggactaggggcctatctacctgcttaactagttgcacctgcaacagttccatttccaaataaggccatgccccacagtactaagggttaggatttcaatatatctgttttttgttttgttttgttttgttttgttttgtttcgttttgttttgtttgagacagagtctcactctattgccaggctggagtgcagtggcatgatctcggctcactgcaacatctgcctcctaggttcaagcgattctcctgtctcggcctctagagtagctggggctgcaggtgttgtgggccaccacgccaagctaatttttgtattttcagtagagatggagtttcaccatgttggccaggatggtctcgatctcctgacctcatgatctacccacctcagcctcccaaagtgtcaacatatctgtttttgcagggggtgaggggttcacagttcaacacataggtaaccctgtatattgacaatttaagaaagaatccattcgggcatcttccctgaatgtctgccaccaacaaatagtacatcagcatgataatttttgcatattcagttttcggaactcctccatggcctttcttttcctagctggcccacttatttcacattcatgagcatgtccctgtgctaaaaggccaagaaatttcgaggatagtgtccagggagtgctcaatgtcccagcaggaagggcctggagcaattactgtagctgctcagcagtgaggagactgaggcggtggctgagctggaactcaaacccctggaagggccctgtttcctctgaacgcgggttcttttttaattttttaatttttaaaattagttaattaatttatttatttttgagacagagtctcgctctgttgcccaggctggagtgcagtggtgcgatctcggctcactgcagcttctgcctcctgggttcaagtgattctcctgcctcagcctcctgagtagctgggactacaggcgcgcactaccaagtctggctattttttttttttttatatttttttagtagagacgggggttttaccatgttggccaggatggtcttgatctcctgaccttgtgatccgcccgcctcagcctcccaaggttctgggattataggcgtgagccaccttgcctggcaattttttattttactttaagttctgggatacatgtgcagaacgtgcaggttgttacataggtgtacatgtgccacggtggtttgctgcacccatcaacccatcatctaggttttaagcctcacatgccttcttccctttccctcactgggttatatccccctttacaaaagcagccattgctgaatttcagccgtcatttaaatttcccccgcatcgtggactgacatgtggtccaacggtcacgatgcatacacagctcatgccacacgcatggagcctccctgaacagggagatagatgccctgtttggcaggatgcctcaccagtggctgtgggaaattaccatccacagttttcagggcttgctctccacttctagctaatctggccatggggagtaaccattcctggactttggtgtcagtcagtgggcagcactggcctgtggaccccctgtggccagccctgagctagtggttcagttcggagcacacagctgcaggtcacagaaacctagctggagaggtggcaactgaacagggatgggtctttcccagggctgagagtccagggccattccgggctgcaaagggccagcaggagcgggtctccttggtctttctactctgcatcctcagggcggcacccccccttgtgctggcaaggtggcccgtcactcgaggcccaggaggaaggtccactacagagcccctgggggctggatttagtgtccatcgtgatttaggagttgtctggggaagtggccggccgggatctgggggcctcggtttcttggggagggtggagtcactttggctggagggtgggaggtgttccctgtccctctctctggaggagggatggtgtggttctagctggcttatgttcagcaccccagggatccgacagtgccattgttggatggctttgctgatggtgacgctccatgctgttccctgggggacacacagcagcgtccactctgggcagactgcccggaaatcaatacagggaatgaaaatgggatctcagatgctcctggttgcacagaaaggctgtttccaatgcagaccttcctgatatgtggggatgaacaccctgagatggaggggactgggtggtgcaggatgtggctgtgacctggctatagacgcccttgacaacgaattatacccacacacggtgggcagagggtcacatctccccctgggctcataggggccagccagagagccagcaggcagctggcatctttctcaggcagcacagtttttaaaaaattaaactgagatgaaattcacgtaacctcaagctaactgtgttagagtaaacgactcagtggtgtttagtacattgagagtgttttatagccaccaactccatgtagtttcaaaacattttcctcaccctaaatgcaacttcatacgcatgagtccctccccatccaccttccccctgtctctgaaagtcactcgtttgctttctgttcagttccgggtagttcctatgaacagggtcatgttattggtgcctcttgggcctggcttccttcactcagtgctttcactcagcgtgacatcttcaaggttcatttacgttgcagtgggtcagcgctttactcctttcacggttgggtcatgttccattgcacggtggggccacaatgtatggattcattcacctgttggtggacacttcagttgttgccaccctttggctggtgctgtgaacaggggtgtacaaatagctgtttgaatcagttttcacatcttttagggtccgcactctgtttttctttttttttgtttcttgtttttttgttttgttttgttttgttttttctttcttttttgagaccgagtcttgctctgtaaccagtctggagtacagtggcacgatctcagctcactgtaacctccgcctcctgtgttcaagtgattctcctgcctcagcctcccgagtagctgggactacagacatgcgccaccatgcccggctaatttttgtatttttagtagagacggggtttcaccatgtgggccaggatggtctcaatctcttgaccttgtgacccgcccgcctcagccccgcaaagtgctgagattacagtcgtcagccactgcgcccagcctgcactctctattttttaattgctcctctgggtctggggatggctcattcctctgtgttgtggagcctgtgtaggcccaacccgtgtgtccatgcagggaatctgactgggctctccccctcccaccaggaggacctgctggtcccgcgcagccccaccctcaaggcccaggcctccccaggctgcgctgtccttactgcaatgctgtcctgggcttggacaccttcctcagctttggtaacccacaggcacacgggtgcacacgtgggccttgcattccccgtgcttcagatccatcagccccggatccgggtggagggcttgctctatcgcattcctcccgtttgtgcagatctctcacctgtgcctgtctcctccccgaggtgagcctcctcatgcagaagcaggcctgggtgccggttatgtggtccttattgtggtggccatcttcgtgctggtggcgggaacagccacccttctgatcgtgcgctaccagagaatgaatgggagatacaactttaaaatccagtccaacaacttcagctaccaggtgttctacgaataggaggcgcaggctgacaggaaggtgggtgcggagtggggtgggaggtgcaggctgacaggaaggtgggtgtggagtggggtgggaggtgcaggctgacaggagggtgggtgcggagtggggtgggaggtgtaggctgacaggaaggtgggtgtggagtggggtaggaggtgcaggctgataagaaggtgggtgcggagtgggggcatctgatgtgcatgtcctgccttgccatccatggtgatggggacggccagcaggattcagccaagggtagatatgtgtgtgtctgtgttttgtggccctttacggagcgtgcagcctcccttctgaaaaagcaaccaggagcaggcagagaggggaaactacaggtaggttggtgaaggttcgatcgcttcacacacccactggactggctccacgataccagcggcagtgctatatgggtgaccacaggacccaggggcccaccacaaatcccatctctgccacccactctcttgaccacccgggcaaggtcctgagcctcttggtgcctcggtttcatcatttgtaaaagaaaccatggtaacatttccggccacgtggagggtgtgagatttaaatgggaagatgcccaagaggccccgctatggggtctgacgccctcaattgctggtggatcctaacgatggtcctcggccgagtgtccctgaaacctggtgctcgtagggattgtcacgtgtggtgtggatgccacagtggaccccccacaccttgctgctcatgcccgcagccccgacttatgtatgaccttttgaggctgaagatgcttctctgatctgccctgtggacttttgtttttcctgggcctgcacatagttcaccacaaatgaatgacaagcattatggagggcagtatggttagtataaaccttcagtgggaaacaccaagactgggacttttgtaaagattttcagattttttttttttttgagatggagttttgctcttgttgcccaggttggagtgcagtggtgcgatcttggctcaccacaacctccacctcccaggttaaagcgattctcctgtctcagcctcctgagtagctgggattacaggcatgcgccaccacacccagctagttttgtatttttagtagatacagggtttctccatgttggtcaggctggtctccaactcctgacctcaggtgatccacccgtctcggcctctcaaagtgctgggattacaggcgtgagccaccgtgcccggccaaattttgagatttttctaaaaaaagaacatgcctgtaatcctagcacttttggaggccaaggcaggaggatcgcttaagcttaggagttccagaccagcctgggcaagatagaaagactccatctctacaaaaaatacaaaaataagccgggtgtggtggcacacacctgtggtcccagctacttgggaggctgaggtggaaggatcccttgagctcgagaggtggaggttgcagtgagccgagactgccccactacactccagaggggaaccctgcctcaaaaataaataaatactaataaaagaagaagagaagcaatcatgaggcttatctggcagcgtgtgagactgctgactccaaatgctgtaagggaagcatgcggcttcggcttctggggaggcctcaggaaacttacaatcatggcagaagaccaaggggaagcaggcacgtcttccatggctggagcaggaggaaggggttggggcaggtgctacagatgtttaatcaaccagatcttatgagagctctatcgtgagacagcaccaagaggatggtgctaaatcatttatgaaggatccgccccatgatccaaccacctcccaccaggccccacctttaatatggggatcacattgaacatgaaatttgggtggggacacagacccacaccatatcaactgcccaccctctcagccaacaggagaacaaggaaagacgagaggccaattttccctcgatgttttaatttcaaggagggggacatccagcatgacccagcaccgacccaccagatgtccttagaaagctagtgggatagtgttggcctcatcgctgggattcgcatcttaaatattaagtaaaaggcactgacatttcctcgtaactctatctagggaggtgactggtctctagcactggtcccgtctatgctgtaagggtcctgagaccccagaatactgcgcatgttagttaccaggagtcctggcaggagagacgggaaagacaaagctaacacaagcgtccccctcacatgggcagaatcacttccacaagcgggtggcgttttctttgaagttgcccagcaagggcagcatggaggttgccttttggaaacgtgtgctgtagtctgggctttgctggtgacctgggaggattggcttgagttctctgggccccatttcctcattttaagattggagccagtgtctactacactttgctgagttgtttcaaaaatctgttatctcaagaaaataaggacctgagcacaggaaagatgggctgggctggagaagctgcctgcccgacgaagagggggtgggctgatgttgacaatgtctgttgtttcccaacatccccgtgaggttgtgctgttattagcatcctgtgttatagatgggaatccagggcagaaagggatagacgtcccaggtcacgtggctaggaggtccagggcaagaagggataggtgtcccaggtcacgtggctaggaggtccagggcaggaagggatgtgtcccaggtcacgtggttgggaggtccagggcaggaagggataggcctcccaggtcacatggctgggaggtggccgagctggggctgcatgggatttccgtttggctctggggtcagctctcttagctaccaagcttagagcctttcttacactagtgttcacatgactgatggacccttagaacaatgccccttgcctttccccttcatcagagacccggagaatttgtattttagcagctgtgcaaggggatccacaattcttaattcttgcagtggggacaccaggtgtcccagttgagaggcagcaactgttgtggttacagggaaggagccttcccaggacccctgagcctccccgggaggcaggtgctgctgctcaattgtggtctgggtcctcagccacctccggggatcccaaaggggcagggaacaacagcgaagtttcagttcaactttacactctaatagtgaaaaataaggaagcttcctcagtttggtagcttttggcctctggtttggggcccatggggtttgggccatgaagaccccctcctcaccaaccccattgcctcccatcctgggcaggagacattgtcaataccagcccgccccctcttcgtcaggcaggcagcttccccagccaagcccgtcttccctgtgctcaggtccttattttcttgagataacagatttttgaaacaactcagcaaagtatagtagacactggctccaatcttaaaatgaggaaatggggcccagagaactcaagccaatcctcccaggtcaccagcaaagcccagactacagcacacgtttccaaaaggcaacctccatgctgcccttgctgggcaacttcagagaaaacaccacccgcctgtggatgtgattctgcccatgtgagggggatgcttgtgttagctttgtctttcccgtctctcctgccaggactcctggtaactaacatacgcagtattctggggtctcaggacccttacagcatagacagggccagtgctagaggccagtcacctccctagatagagttacgaggaaatgtcagtgccttttacttaatatttaagatgcgaatcccagcgatgaggccaacactatcccgctagctttctaaggaaatctggtgtattggtgctgggtcatgctggatgtccccttcctcgaaattaaaacatccgagggaaaactggcctcttgtctttctttgttctcccggggctcctgtctttcgaagtgagaactgtctcaccagttctaaagttcctgcagacatctgctctttgaaaaccatcagccaacccacccacccccaccaggtcgacccttgggcagccccactcagagatgttcccagagtcctggtgggttctccacggatggtgcaaaggtgcaggggccccagctgtgctcgtctggctcaggtatcttcaccagccacccccaccagttggcgtgtcaggagcatcgctcacctgagggcaggcacagccccatggtccccgttccactgggcactctgggagtggctgccttttcattaggggcttgatctgtccctctccagtaaacatagacgccatgtcctcgggttggtgtttcctccactacccctcctcctggggttttctgtattaactttacctttcctgcgtgcaagctgacccaggtgacctcttcctccacacaggtcgccgtgagtcaagctgcctccagaacctcagagcttccctggtgggctcccccgggatccccagtgtctctctgcacctccacccatccctcggttcttaactcttcaagccttaacggaggtctgctctgacgggtgggctctgccagagcccgggtgagcccagaaaggaagacagcagccaccgtctgtcccgaagaggcaggccgtcctgtaggtcctagaggagccacagcccaggggcagatgaaggggctgcggaagacgggggcagtcctgggggtgctgcggctacaccaccacccgcgcggcccccgcagcctagacctcccaggcctgtgaccctccacaccagccctcagaaccctcctgggcttgccctcccttggcgtccgtcaccctttggcaaatatagaatatttcacattctcagagagacccgaccgcgctcttgatgctctttcgaaaataggtcagtcttagaaatacactgctaatgttatttttagtggatgtttatgctgtttgacttttctcctgtgtaccaaggtattgcttttatttacacgacagcgactcaaaaggcactcgattaatgtgacaaccttttcaataagcagaaataacgtaggtacacatcactctttacatttttctaagcattttcacagccgtttcttcatataatccgaccacagtgggaggtgtgatttacccattacacaatgagaaaccagaggagccgatgagttacttaattgaggtcacagaatgaattagcaagaaaatggttctaaaatctaagtattttagtctagaattttctccattacatcatcctaagagataatgctctgtacttcatttgaaataaactggaattgtattagatagctcacacctgaaagtagagtgtttttcctcagtgaacttagaattataacatggccttagttttcaacccatgatactaattttgttgaatataattaattgtcattcatacagaacatttggggaaaggagtattttgatttactggatattctcagagtcagtaaagaatgacagtgggtaatatgtgtggatcacagattctgatcaagtagaatcaatcgcataagacactgaaatgtggctggttgtgctggatgctccatttgggatggtccatcacaggctcgctgagcatccaacgagggccggtgctgtgttgggcacgctggggaggccagaaacgcatctctggttcttcccaagtcatgtcccgctgttctgatgtcagctgaggagctttcacttgcctttcttggaagagcatgacacatattcagtaaaaccagctgttgagccccatgactgtgtggctctttggatttcagataaagtcattgacatatatttaaaaaccctgtctttcaaacttcatctacagttttcaagtaatttttttttttttgagacaaagtctcgctcttgttgtccaggcgggagtgcaatggcgtgacctcggctcactgcaacctccacctcccgtgttcaagcaattctcctgcctcagcctcctgagcagttgggattacaggctcctgccaacacgcctggctaatttttgtatttttagtagagatggggtttcaccatgttggccaggctggtctcgaacttctgacctcaggtgattcacctgcctcagcctctcaaagtgctgggattacaggcatgagccgctgcgcctggcctcatgtaatcttaatacatgtgccacgtctgttcatttgtgttttctgtaataatgaaaacttggtttcctgtcatcctacctcccccatccaagtctattcttcgacaaacacttcctgagcactcacagtgctccaggccctgagcttagcgctctgggcgaagtgatgagagggacagaccaagccctgccctcacagagcacacggtcttgtgggggagggagacgctgaagtcagatgatgacagccatggtaagtactgagagtgatgattgcatgtgtgctgtgagatgcccctgacctggtcccttcatccacccatctaaccatctaaccatctacccatccattcacccaccgacccaaccacccatttgtccacctgttcacacatccgctcgtctgtccatccatccacccacccacccatccacccattcacccatccatctgtctgttcatccatccaaccatccattcatctattcaaccatccatccattcatccactcaaccatttatcgatccattcatccaaccactcacccatgcattcacccactcatccacccctccatccatccatccacctccatccacccatccacccaaccatctgactgaccatccactcaaccatccatccatccatccatccatccacccacccatccatccacccatccatccatccatccatccatccaaccaaggaatgtgtattgagtcccagtttatatactgacatgaggaagacaagaaaaatgaggcagagtttttgccctcaagtattcacaatccatctgaagaaaaacccctgtggatactataatacgtgcagtaaatacagggaggcctctggtggaaggaagagagagaaacagaaaaatgcacgtctatgcatatggacttgtgcacctgttcccattacttcattggaagggctttgggatgctgctgtgtcatgactgctgtttaagaatattatcagcatgcatattgcttgcagcttaaaccctccgatcctagactgtttccactggcatggcttaagggattaaatccaaagtgtatggaaacagaaggaggaagggagggcccctgggtgacccttggatgtctgtagaagttgttcactgctctccagtgcagatgtcaccccagggttgtgcagtgcacaacctgtaaggccagacttcagggccttggagacttcccagaagatctcttaacagactgagtgggcaactcaaatcctcctgtctgtggaagcggggaaactgacatagacatattctatacaagcctcattataagccctccacaaatgattgttctcactgcgcagttgaggaaatggagacagcaacttttctgaagccaaacagctggccagtgaaggaactgcaattcaaaccaagctcattgggtgtaaagttcatgccaccctctgctttctgtgggggatgggaaggagggtctttgcaggctttagaactcagagtacctctgagatgtgggaagagggcttaggggttccccaaggccagtgggccttgggctcctggggttctgggtccctggaggttctcatgttcagacactattgggatctcaatcttcctggcccaggatcccaagctgtgaatcactggaaagtggaagatctgatggaggtggagggtctgatggaagagaatctgatggaggagggtctgatggaggtgaaggctctgatggaggagggtctgatggcgggggagggtctgatggaactggagaattactggggctttccatgggccctctggcccaggttgcatctctccatgctggccactagatggcgacattagctggagtccacgctggaaaccgaatgtcccctgagtttccgcagcaaccacatccctgggttctcttgtttgttctctttcactggatttgagcctcttgcgtgtctgaaattgttctgcagacctgcaggctccggggcacatgtgtgcaaaggtggtgccctggaggccctgtaaatagctcagaaagtgaggctggtcttcttcagagactgagtgattgcgaagtgcaggacaaatgagtctatgtgggggccacagcacggatgtccaccctcccatctggatttcccaagaatgggagacatcttttccctcccttcccgtttctgggaggacaggggcagatggacaggcgagtaagacaggtggcagggagccagcagccctaggagctggtgctggggaggcccaggtgagatccctgtggctcagaagaggacctctgcatgtggaagggacgcccgcaatgcccagtgacacctctctctattgtggagggtgacggagtctgctgaggtagccacataagcacctaaaccagaagtgagtatctaaaacggccttgcatgccataagtcatcagataagaggggctggacaggggctccccaagcctgtcctcagctgtgaccaggtggctagcaaccctctttagtttgagcacctgctttgtcccagagagggagtattaaatgtccgctgttcaccccccacgccccatctctgtccctcctggggaggaaggctgtggtgggagtcaaccctcgcatcccatctctgtccctcttggggaggagggctgtggtgggagtcaaccctcgcatcccatctctgtccctcttggggaggagggctgtggtgggagtcaccccccgcactgtgtctctgtccctcctggggaggagggctgaggttggagtcaccccctgcaccctgtgtctgtccctcctggggaggagggctgcagtgggagtcaatccccgcaccccgtctctgtccctcctggggaggagggctgtggtgggagtcaccccccgcaccctgtctctgtccctcctggggaggaggggtgcagtgggagtcaatccccgcatcccgtctctgtccctcctggggaggaggggtgcagtgggagtcccaagatgcaggctcctcccagttctctgctcacctgtgctgaggctctgcgatctgtggaatggggccgtgttgcaggctcttgtaaggatcagtgttgcccaccgagggcccagcacacaggctcctaaggtgacgaagcacacatcctgctgccaaagtcacagcagcagcggcgccctcagacgggcccgtgggcctcctccgcacagtgtcgggtgctgagtgcctcttgtgggctctgggcttcgcgtccagcactgccaaagttgcccaggtttcacgggaagctcgcggcaggccgggcccagcagccttccgggagaaggacactacgcatctgcggccctgcatgcccccaggagcccatgggctccagcacgggggtgggcaaggggcgagagtctggcccctcatctcctggcagatttcaaagtgtggtcagaaacatagctggactgggcaactggctgaagtggaagtcatcattcagctaatgaggcttgatcttttctccatcccctgctactgctggtgtctgtgctggcctggagctcaccccacctcacccgggcagagcaaaggcccttggctggcagatgctggagggtctgtaaacttgctggtgaatgcccggctgtggacacacagcagatgcctgtcaagggagaaggagccaaggagagccctggggattcccaagagctttagggtgtagggaaaatcgcccaggcaggctgattctgcgaggcttgtccctatagcaggagatggcctgtgcgaagtgggactcctgggaaggagcgatgaggactagagggaaggggcagcatgactccacaggctctcacaagggacacagcatggacatgcttctgcctggatgcccctctgagtcgacagagatccatgtgccctggcatcaaggtcaggcaggggagacgtgcagggagtggagtggacaccagaggggcaagcaccacggtgtggacaccgaggggagccatgggtcctgggggtggcctgggactggactgttgagtcttgggtgggcagaaatcgttcccctcatcaaggactgtagatcctcacttgcgacacccaggacaccaaagcgcttctgttactggataaaaggtcttgactgtgtgtcatccaggctctttgtgttgaacaaaaaattgaacagaatgcataaacaaagcaaaaaagaaggaagcgacgaaagacaaagcaacaaaataacagtaaataaagtgcaggtatattgaagctaaagtacacttcacagagtgggagcaggcttgagcaggtggctcaagagcccccattacaatgctctttagggtttttataaagctcaaataatctggtgacacccctaggcaccctttagaagcctccaattagtcagaccctatgaaggattggcctgtgaccaatcagaagctgaagtggaaacttctgtcttgttatcgctggagtgaggatgtggcccgtgtgctgcctaatcttgcctagaactggctgcacctgctgttcttttgcttatcccttaacccttggtcaccctaatccctattctcctgtctcagttctgatggaaagaaagtgacagatgacctggaggttcctaacccagggaatagctagagttcgcatcccacaaactagtgttagactgtgggaggctaagggtatgggctttgcggttgtgagagtttggaggttgaatctcagccctcctatgtggggcatgtcacccaatctctctgagcccctgtttcctcatatttaccccacctgtgaattgaagctgttgctagcattggttagggaactttgggcaacaagcaatggaaatgtcaactccaacagtctttaaggataaagtcaatttatgaccccttgcaagtgagaagtccaggccagggtggagctcaggtgtggcttgctcctgcagctctcaatggcccagattttgtctgccttttgctctgcgttccatggtattagtttaacccaaagctccctcttagctcccaaatggctgcgagcagtaatcaggactaattgctcatttgtgcatgtccagctgaagacagaacaggtcttcccccaactacggattaaaaggctgggttaggcggggcgcggtggctcacgcctataatcccagcactttgggaggctgaggcgggcggatcacgaggtcaggagttccagaccagtctggccaattggtgaaaccccatctctactaatgatacaaaaattagctgggcgtggtggcacgtgcgtataatcccagctactctggaggctgaggcaggagaatcgcttgaacctgggaggcggaggttgcagtgagccgaggtcatgccattgcactccagcctgggccacagagtgagacgagactcgtctcaaaataaataagtaaataaataaataaataaataaataaataaataaataaaattaaaaaaggttagcattatctcttgattgaaatgtcctacgtgattccccgactccgagcctgtcgctctggccaggaggatgttgggtgctcctgataggctgaggcctgggctatttgcagtgtcaaagggaaaggcctcatgctgttggttcattagtgagaagccacaggaaggtgacatgccagggaaagagactaggctctgtgttttgggttcacagcatgcaagcatgcacccaaacatggaggaggggacttgagtgtcttttgaatgggtctacactgatatttgcttctctgacctccgaaggctccatctcctaggacgttttccgggagccagggaaagcaggatagcagagcctggtcacgtagtgctttgagaatgcgctgggtgggcgagcggtgccttcttattgggttgttcttgtgaggagcattctgattcctacttagaagccctgaatgaaggtgggagcccctgacgatggcagaggcaggtatgtctagggtctgggggcacctggtgtcatctacttgagtcctctttgaactctgcatttggcagctgagcgataccgaggaagtcacttcccctcagcgtcaagcacctgtgctcatcctcaaaggggtcaatgacgcttaggtcacactctccagggcccagagctgctgagctgcacacatgtacgtttctccatgagaccatcttgggggacaagtgctggcacccccacatggtaggacaaagacagaggccttgagacattagtaacctgcctcagatcacacagctggggccagaccagagcccaggctgcccgcggtcatgtcctaggcaccatttctcataggcatcgttgagtgggagtctgggctaaacaagaccacactggttttgatgacggcattttctgcccctgtaccgcatggtaggccagggcctccctcccacctggctacgctgcgcctccaccttcactctcagtctctgtaaagacatgttttgagtgcttggggcagtcgctgagaatattaaagacataatacaggggcgtgcacgatgtggggccttggtacaggttggtacaggttggatccatgcctgccctggctctgggaccctcctccccaggatagagccaggacaggtggggagggggtcactacctggcatgatccgccaggagctggggcagagggacggagcctgcctggcaacagccatgatccaccaggggctgggcagagggatggagcctgcctggcaacagttccagggggggtccttactgggacttccccttcccaggaccgccagtcccccaaacacagcgggagccctggtcagggaggctggtaacctagggggaagccagcgctggagctctggctgaggatggagcaggcactctctgttcaaccctccaggaagccagcatcaccaggtggctggggtggcttctggcctccactgtctgcacgctgtaccctggagctgccttgggaaggtttcggctcctgcagctcccccacgccaatgcagacattggcctcattcagagcaggtccgctcttccccaggggcaggcccctctcatgcggcccgctttcactttatcggagtcacaatgatctgacctcctcctattgatcacgcacagcatttcctgggactgagtttaatttctaatatctgccccatcaggcccctcctgggcaatcctcttccttcctggaaggtacattaaactctgaggtttcacaagggctggctgcatccctgtgcaggcagacaggaccccacacacccaggcgagccctccttggcggcctgttcatctgcagggattcttccggttccccctctggacagccccacggcccagatgccttggcttcccagccacagatccctcattgacctcccctccttgctggggagaggcaggcgctgggtcatccatggggcatgaaagtgacagctacaccctccaagcccgctgggtccctctgccgggtgcctcccatacctgcccctctgcagttgagcaggtgagatctgctgggggaggaggtggccccaggatccctgtcgccgtcccggcctccccgctgccctgcactggctcctgggcttctccttggccctcagttccacggcttcctggctccagcctcctgcctggggctacccagggccgtcaggggcttagttgttccaggaggctgttgtacacagaaaacaccttcatggctgcttgaacatttaatatataatttattgaggttaatttaaaaaaacaattagttttccttaagtaaactcaattcatgaatcttatttatttgttttatattcatctgggagcttttggcaatctctttcagagggacttttgattaatgtttgaccaactcagttgaaaaaaaccctcatgaacagtcaattctgttaattaaattccctcagacatttacactgaacttagaaatttatttgattttctttttaagacacttcagctgcctgacccaagtacttcagaggactctgagaaaaccactgacacctttgtaaacaggcagctcccagagtccaggaaacattccaattctacttatatatctagtttgttttgctcacacctttcaatttagaatcactagtctgtagagaatggcacattttaaactagaatcagctgttctggggaataaactaggaaagtgtgtgctgtgggagcctctagtatgcctcattctcttacacactgtaaacactttcaaacacatacacagactgtttcagaacacagcaggaaagtattaatatgataggtttgatttacttcatcatctgcaaacaatggtaaaccttcctggagttgaagtgctttctccactgtggaagcaatttcctgtagcaagaatggggttactttctctaagtgtgcgtgatttcggtctgggcttgagacctgggatcataggccttctggatgattctgtgatgccactgatgagaactttggaagctgccctgacacagacctccacatcctccagaggggccagtctcccaggcatgacctggttcagataaatcattcccggatccttccatcagattagtctgtgcccattgcccggtgacttcaccactgattagattcaatgtttctgcttcttctcgagttattttcaagctcttctgaactggagaagtacaactgattagattcaacttctctgcttctctttcaagttattttcaagctcttctgaactgcaggggtacaactctcacaggcagagtctccatgtcttttgtgctctgcccagctaggtggttcctgggctgtgatgctgcctggtgctctgggctgccccttgatctgtttctgatttagcatctggctctagctcctccactgtggtcctggccctacctgtgctcttgcaaggagcgtttggcctattcaaaaccaaaccctaccacccagtctgtccacgtgtacttagagagtgtggcacaattggttggctgtgtaggactgtgagctttagagaccttcatacacatttgatcattgatcctcacaaaggctgtgcaattagcaggcatcctcccaggttcataggtggggaattgatgccaaggcacgtga

SEQ ID NO: 480 - DNA, 109423 bp, Homo sapiens
cataggatgaaatatttctcaaatcaaccacaaagctgagaagccagaaaatacaacaatcctcttcacccctgacatttcagtcttacatgagttgactgacctcaaagtcaaaaaagaatttatttgtttaattcagattaggtggaaatggcactggtaaaaattaatcttgtaatcattcgaaatacggaaaacagaaattttgctactttatgtgacatgcattttagtatatactgaaatacttgcagcttgtagctcaaaagactattttaaaagtggaggacaagcatggcggctcatgcctgtaaacccagcactttggcaggccaaggtgggttcatcacttgaggccaggaattcgagaccagcctggccaacatggcgaaacctccactctactgaaaatacagaaattagctgggcatggtggcatatacctgtagtcccagctacttagcaggctgaggcaggagaatcacttgaacccgggaggcaggggttgcaatgagccaagattgtgccaccactgcactccggtctgggaaacagagtgacactctgtctcaaaaaaaaaaaaaaaaaaaaaaactggagaattggagagtcggttataaatacccccccaataataatttaaaaataaatgtagcgagagcgcccaaaatgacaccctagtagcaacaagcacacctaggcacgagaacttggttttaataccattcttcaataaaaggaatcagagatctttaaagaaatagctgactctaggactgcgacaggaaatataaaagatgagtctggggcatgtatactgccaggaagcaataaagtgctaaaaaaaaaaaaattgataggaacatgtcaaaggagaacagtagacaactcgaagagctgccaatggccaaagctggtacaatttgagcaacaaaataaagaagtactggattataatataagttatgtaataaacatccacaagcccataaggatatgataaaataaactaacaaataaatgtgagggaagacacaaatctcccacagagaattccaaataaattatgtaaatattccaccctaactgaggaagagcacaactgtccattcagtaagcgtgggctctgcaaagtgacttccttccaaagagaacagtataaaaaggggtgggggaagtaactttacagtggataaatctaacaaacgctactccagaaggatgatcaaggtcagtaataatgtgataagtcaccttgatagtatgtatccttgatagcatgtgttgaaaagggcatcttacctctgtgatcttcccctgatatagtccgtaaggccattttaatcatgagaaaatcgtctggcaaattccaatagcagggcaccctacaatatacctgaccatactcctcaaaaaatgtcaaggtcactgtattagtttggtatgcttgccataacaaagtaccaaagactgggtggcttaagcaacagaaatttatttcctcactgttctggaggcgtatagtgtaagctctatggggttgatttcattctaaggcctctctccttggcttgtggatggttgtcttctccctatgtcttcacatgatcatccctctgtatcctactctcttcttataaggacagcagttattaatatattgggctaaggtccaccctagtgacctcatcttctttaaagaccctctctccaaatacagtcacgttctggggtactgaggttaggacttcaagatacgaattttagaggggcacaagtcagcccttaacagtcatcaaaaactagttaagcctgagaaactgtcacagccaagaatatacagcctaagaatatacaacaactaaatgtaatgtgatatcctagctggcatcctggaacagaaaaaggactttaggtaaaatgtgaggaagtaggaataaactatggaccttagttaataatttatcattattggttcattagttgcaacaaatgtaccatactaacatctattaataagaagataaactgtgtgtgtagtggggacgtcgtatgtgctcaacgtaaacaaaaactgttctaaaacataaagtctattagtaagttaaaaaaaaaaactctcaagaacatctttaaagaactgttttctctataagccctttgccactttacaaaaaaattccacaagtaaaatctttagtagtctggttgctgttgttttcgccctgctgcactcaaatgaggaattctaagtttattttgttttacttgggggcagggggaagtaaaaagatgtaaaagattaatgttgaattaaaatcttaagctagaatgttaatttaacaacccacaaacaaatttgtctaatgctcaatttgttcagatgacgatactatccaccacagggtaaaaaactgaaatattggatactacctttagcgaagcttaacacataatatccatcattgggtaagaacacacgaaaaacacaaactaaggaactgcgcctgcgtagtcagagcctcaaagggtataagctccaggtcgcgagcccccgcctcctccgcccccatgaacccccttcccacaagggggttcccactgcgcacgcgcagtgtttaacggccggtcaggaacccaacaattagtcccttctcgtccgagaggaaactctgtgagaagatgggaccgtgagcactctctttaacaaggacatttccttttcagcgaaagcagcgctctgatttaccaagtctggcggaccgcagcgctttaaaggaatgaggttccagcggtcgcgccaagcagcgtacgcagcctattttaagttatgctaccttcgccacagaaaccaagaacgttgtaatggtccggcaagtgcccacgtataattgttctccatcacttacccactctagttcgggaacacccttgtcgccgccgttccggtaacacctctccaacgctttcgatgcttctacttcttcgggaacaagacaagatggcgcccgatttgtctcacccggaagtaaagaataataacatccgtttgtcatctgaagccataccatctctcatccaggtttgtgaacacgtgattgtgcggattgacatgtttcggcgccattttttttgtgggcaaaaccatctctactctggtcaacaccgggcaactgaaccattcctgcacgttactttttaacgtagctggcgccattcccgacccatctttatagtggccagaaagccaagaacgtaagtgttctacacatagggcgccttcaaattttttactttagcaacgtgatcttcctttaaggggaagtatgttccctcctagaaacactcccgccttggagaaggggttgagttcgcaactccacttacagactacggaggaaccccagggtcaaaccaaaccaaaccaattctggccagttgcttagcgcagttcaagttacttagtgcgctggaagcggcatttcaggcaatccaacttctggctcgaaccttctcggagtattccaaggatggaatactctcacttgagcgctgccgagggtgccgcttgaggaaaacgtgagtttgtgaaggtgagcagtctgggtcggtagcgaaagcggagaccttagctgaccccgcagctgtctttctctttgttaacctcaacacatcgcgcccccttccgggaacacttgctcttctctccttggcttaactagtcccggtttttcattctttatccgtgacttttagggaaccgtgggggggaagtctggtttccgtcctgctgctttccttcaactacaagatggcttctcaaaaggacgcatgcaatgccattcctcaaagacagtatgttgatttcacagtgtttttatatgaacaacgttcaagtgtcaaaagtatcaatttccaggctaggagctacaagttaaaaggaaaacaaaaatgttccaaagatacagtgtttattagctacatcttgggaagtgcctttccagagagtaacatgaaaacttctgcgtgacaaagtgcacgaagtatctgaattatttcattgggcaattgtcgtgcaaaagaaatagcaaattaccgtagaaacaaaatagtaagagcacagctagatggataaagatacagatgtgaaaatatagatgccctttgcatgaaaattcagttttcctcagcactagagacccagatactcctgaattagcattataataaagtcgtcactagctaaccatctgcctttcctccaatccacggacgtggtcctcaaaataacattttatcttgtgagaaaccttcattaattacacctaacaacaccatgacgcaggttcatgaggatactactgaaggcaaaaggaaatccctatttctctgaccctttccctaatttccacttagcacaaataagactactggacagtctgattttaaaaaatcactgtatgggccgggcttggtggctcccgcctgtaatcccagcactttgggaggccgaggcgggcagatcacttgaggtcaggagttcaagaccagcctggccaacatggtgaaaccccgtctctactaaaaatacaaaaattacctgggcgtggtggcaggcgcctgtaatcctagctactaggggggctgaggcaggagaattgcttgaactcagggtcagaggtcgcagtgagccgagatccctccactgcactccagcctgggcaacagagtgagtctctgtctcaaaagaataaaataaataaaaaccactgtatggagcaaaaactagaaggacatataccacatgttatcagtaatctctaattttgctctgtgattttgtgcattttccaagttttttgcatcaggtctgattttcaagtttaattctctgagaaacattctcatcagaggaatgttctatcttcttagagaaacctgattggcctagtgaaactgtcatgttcctactctctataatcatattgtaattctttgcttgtttccctagtaaaggtgaggcaattttcgggtaagggatttccccctcacctctgccctccaagtggccagcatctgctttgcacacagaaatttttacatctgctatatgtttgcattaatatgttcaacaatgatcctaatgtaggccagtcattttggaaatgcattgtgaagtggagaggattattaaatacctcacattttgttccttgtgccagtttaatgagacaccctcagcaattgctatttaccagaccagaaaatgaattttacagttccaattccagttccctttctctaaccactctgttctaagagttccccgtaacattatgatcttatggacacatcaggtaagtgtatgtatttcaacacagaattttctaagaatgtgtgttgtggtgttaaatttctatgtaagcagctgtcacgtgcatgatctgctgcagtttgatcatcctgcgcctggatcatcaaatgcttagcagccatcattttaccagtcttatctgacaatctgctgttaatgactaacaaccaggggactttataggttaaaatttttattaacttcctctgttttcagtgtttaaagtagaaaatttggccaatgtggctcacgcctgtaatgccaatactttgggaggccaaggagggtggatcacctgaggccaggagtctgagactagcctggccaccatggggaaactgcctacaaaaaaatacaaaaattagctgggtgtggtggcccagctactcaggaggctgatgcatgagaatcacttgaacccgggaggtggaagttgtagtgagccgagatcgtgccactgcattccagcctgtgctacacagcgagactctgtctcaatgaatgaatgaatgaatgaatgaatgaatggagtgaagtagaaaattctaggggaggacatgtcaccttccattattacagaaacaaattatccttaaagcaaaatggaaataagctaagtaagatgatatgtggaaaatatatcgaaataggaactattgctgtttcttgagatttgaacctttatagtgttattaggtgccatatcacatccatcttaaaacctaataaaaatttaaagctgtggtatatatatacaattgaatattattcagccttaaaagggaatgaaattctgatacatgctacaatatggataaaccttgaaaacatgcaagatgaaataaaccagacacaaaaggacatatattgtacaatttcacttatatgaagcgcctagaatgggcaaattcacacagatggagagtagaatagaggttcccaggagttgggagaaggcgggaatgagaagttactgtttaatgggtacagagtttccgtttgggatgatgaaagaattctggaaatgtgaatgcacttaatgaccctaattatacacctaaaaatggttaaagtggtaaattttatgttgtatatattttaccacataatacaatggaggatgaaaaatatttaaagctagtatgctacaggcacatcattacaaattacaactttttttttttttttttttgagatggagtctcactctgttgccaggctggagtgcagtggcgtgatcttggctcactgcaacctctgcctcctgggttcaagcgattctcctgcctcagcctcccaagtagctgggactataggcgcatgccaccacgccccgctaatttttgtatttttagtagagaaagagtttcaccatgttggccaggatggtctcgatctcttgacctcatgatctgcccacttcagcctctcaaagtgctgggattacaggtgtgagccaccgcacccagcctactctttgattcttaatatagttacttaagcatttcctagatagtagtgaatctggcataatgaaatacgagggtataaaataatactttagttatttaacaatagatcccattgggctttatgcaggtattgtccatttaggccaggttggagaaagtaaggtaaacttatgttcaatgactgcctgttcttacctaaaatcttttgtgattcaaacttgtggggaaaagcaagagagatcagattgtcactgtgtctgtgtagaaagtagaagacatgggagactccattttgttctgtactaagaaaaattattctgccttgagattctgttaatccataaccttacccccaaccccgtgctctctgaaacatgtgctgtgtcaactcagagttaaatggattaagggcggtgcaagatgtgctttgttaaacagatgcttgaaggcagcacgctccttaagagtcatcaccactccctaatctcaagtacccagggacacaaaaactgcggaaggccgcagggacctctgcctaggaaagccaggtattgtccaaggtttctccccatgtgatagtctgaaatatggcctcgtgggaggggaaagacctgaccgtcccccagcccgacacccgtaaagggtctgtgctgaggaggattagtataagaggaaggcatgcctcttgcagttgagacaagaggaaggcatctgtctcctgcccgtccctgggcaatggaatgtctcagtataaaacccgattgtacgttctatctactgagatagggaaaaaccgccttagggctggaggtgggacatgtgggcagcaatactgctttgtaaagcattgagatgtttacgtgtatgcatatctaaaagcacagcacttaatcctttaccttgtctatgatgcaaagacctttgttcacgtgtttgtctgctgaccctctccccacaattgtcttgtgaccctgacacatccccctctcggagaaacacccacgaatgatgaataaatactaagggaactcagaggctggcgggatcctccatatgctgaatgctggttccccgggtccccttatttctttgtctctgtgtctttttctttcctaagtctctcgtcccaccttacgagaaacacccacaggtgtggaggggcaacccaccccttcaaatctatctacagatgagaagcctactaaaattttaagaattgtattaaaaacacacacaaaccttggctacaacaacttgtggctattccaaattaagagaaattacagtccctagtcatctaagaaatggtctcaaaaaagctgtgcaactcccaaagttggcatatatatccctcagtagctgttcagatgtagccatgaagattaaaaaaaaaaaaaaaaaacaacaacaaaactttcccagaggttggactctagagtcacggagaacaatatacaagggaattcttcctaggagatagaaaagaaccctaatcatgaatataccccatacctagacttagggatcctaactgtatctcccattcttcttccccattcagaatgtttgttgcagatacagttccaccactgtacattaagtatgtggaaaacagaagatatccttttggttcctgggtctccagaacagtaggagcaaacatccaaatctgatatagcacttccagagagcctggtcttggaggataaaactttaccttgatgggacttttggccccggtcccttaagagttgggatttggggttgtactgcagcacaactcagcctatcctaatacatatgggaatgcaaacatctcagatatttcttcttgggtgcaatttaaaatacgtatgaaatggcttcagaagtgtccatgaaccttcaaaattacatacaagaattagggagatacatttttctgggaacatacagatgttaagacttcccttctccgtctctatattgccagaagagagggccccagaattaaaaccccatccttcctacaacactcagctttctctttcaggaatatcagtactaatatcaccatgccttttatctctaggatatcttcatcccctgtaccttaatttctgcatgacttcatagggagtccatattgcttgatttttctccatatcattaccattgacataaattttccttacattcttagaatgtgtatttcctcaccttttagatttctggctcttatgttgactgctgtatccctagtacctaccacacaacaggtattcaacaaatacttttttttttttgagacagtctctgtcacccaggctggagtgcagtggtactatcttggctcagtgcaacctctgcctcccgggttcaagcgattctcctgcctcagcctcccaagtagcagggattacaggcctgtgccaccatgcccagctaatttttgtatttttagtagagatgggtttttgtcatgttggccaggctggtctcgaactcctggtctcaggtgatttgcccactttggccacccaaagtgctgggattacaggcatgagccactgtgcctggcctaaaaaatacttactaaatgactaaacaaataaaagatagtctctaactttcatcataatctcaaagagcttcatgatctggaagaagtttagacacaaatgggtaggcaaagtatttcttaattgctggtgcaagaccttacccttgtcttaataattatcctgtctaagtaatacaccttttaagaaacccctgaaaggaagatgatcgtccttggtagatactgaaatctgaggtaaagtggcccataaactgttttgaaatagagaatttctaaaatatgtagggtattttgaatatagctgagaaagctgctatgaactgaaggtttacgtcccctacaacattcacaaatcccaaatgtgatggtatttggagatagggcctttgagaagtgattaggtcatgaggatggaaccctcatgaatgggctgcatggaaaaggacccacagagatgccttgtacttttcccatgtgaggacacagcaagaaagcactgtctttatgaacagaagtgggccctcaccagaccccaagtctgctggcaccttgatcttgaagttcccagctcccagaactgtgagaaataaatttttgttaatacaccacatagttgatggtattttattatagcagcctgagtggactaagacataagcaaatgcattgttgataaaacattctgtcaataacgtaaactgtgaaaattccaggaccaatcttgtaacatgagataaataagaatatttattatgcatgttttatacagtaacaccaaaataacgctcaataagttacacagctgttttctagaaacatggcaaaagaaaaaaaacagtaggaataatatgtattactcaaaattgaaaatatggtcatcttttaaacatttgaattcatgatttctacgtaaacaaaaacatcataaatatctagaaataatcttttttaacaatgcactagatactatctaaaggctcaattttattgcacatatttggtttaggcttatttgatcaatacatgcagaaaaataaattacaaacgtgaatttttaaaaggaatcaggatgtcattttgtactacaaaaattagatgagggttgatacatttcacagcttaatcttcagaaaattttcttcagctattgcataaaatcactgattaaaatcatcacacatggaagctaagaactattaaatacagtaaaatagctctgttggtacatttaaaataagagaacaggcatcaactattctttgaattgataccaactgtcttctttttatttatttttgagacagggtctcactccgtcactctgcaggaatgcagtggtgtgatcatggttcactgcaccttgacctcctgggctcaagcatcttccccactcagcctcccaacagcatgagccaccatgcctggctaacaaattgataccaactatcactcttctcagctacctaaaaaggtggtcttcacaagttttaagaacattaaatgacaatattggcacataatcaatattttatcattttatatttggaaaaaaacgggaagctggggtaaaccagtttctaaataaagctaatgaaactttaattcattcaaacactatggtagttatgttgatgataagtaaacattattatttatttatactgtttcctgaggtgatccagaaactactgttattatagtagacttgctactatatacatttactatccctgcaaatgtgctttggaaataataacaaaaattttaaggtagacccatgtgtaatttaacatgctttctctgttacaaaagctatctttaggaaattcttaagtatcaaaaatccaatttattccattttcagaagacaaggaaaaagcactcataaactctaggccataaaaaaataggtttcataagtagctcctttaacatgaagaaaatgacaataaaaatatcttacttgcatgttacttctggaataatgtcaaaaatctatgtagatctttccattttaaatgatgttaaaatagtgtcagcactgtgactgactcatagcaagtatgggtatctatccaaatatttgtctttgaaacaagaaacaagtgaccatccgatgaaaagtgcatgcctcttaacagtatctttctgtaagaaaaattaggtgatctatatttacatttgggcagtggggggatgaaaactgctcttaccaagatggctgacttgaataaagacagtcaatatttttcaaaaaattcactgctctggtactgagatctccatgataacagattacagttaaacagaaaatgctgtgaaataccttttacagaacacagcctgactttgcagattaacttaaagatatatttcttgattatttcactgttaaaaatcaagaaaaacactactaacatttcaacatcttaaaaatagaatttatgcaatgacatttttaagctctgcattttgtatactattaccgtctttaattacagttatgttcatccatatatcaaaaggcagcactggtaaccttgataacattatatatgcttatgtgtttaagacagtcttgattaaatatttccataccttatctgcagccactattcttatcctttcttcccaggaggagaatgaagtgggactaggcatttacctggcacttgcctgcactatcattcattggcactaatgattaggatgcttgaaccatgcagttttgtttctatttcaacaatatgacactgaagtagccattatcttttgatatttaagcctaagtaatagtatattcttcatgccaagttttgacagctcaataatttgtattctagaggggaaaaatgatatttttgctattatttaaaaagaaaatcaaaaatgccagcttaatgccccattaaaagctaaattcacctgaacttattaatgatgcttgctgaagacaaagtgatttcaaaaccccaaaactgtgtttagtatttacaagaagtagaaaaagtatatatttttctgttaagaatataattctctatcatttacaaatataatttggtaatttatatttcaaagctatcctatggtcctatatggattatcaacttctaattgccaattctaaatgttataatcatctatattgggccttggccaaccacctgcaagttatccttaactccaccatgaagagggtgcaagagatatgtttatgaaatgcctcaatataattctagtttttcaaaacctcaaggtaataagctaaccagcagattatttgtaaacccacactactgaaattacagtgacacccttttatatggttgaattgtataaaatatgaccagggaactacaccgtattaggtgttacttcatgaaattatgtgttatagcagtttcctaaatggtagtacacatatataccactagatggccctgagatgattttaagttaagtggtacgtggataaacaatttttaatagttttactttaatatttattataaaaatataaaagcacataaaacacggaatatgattgctcaaaacaagactaaggttacaaaaggctaaaaatatattttttaaaataaccatgatatagaatatgtgagagttcaggaaggtggcattacatttaggaatcactgtctcaaggaatgatttgacttagccagcatcatttctgaatgcttgtaataataagccacatcataaaggggtttcctttcctactgtaaattctgggaagtttttgtaccccagaataaatacctggaaacaaaattcacatttattttaagactatgaattttaaagcattgagtaaatttactttaaaagggttcaccaaaatggtgaaaaagttcaggaccatttgaggaacatgctattcctacagaagagggaagactagaaaggcacattatatattatagttatcactgtggcattcaaaaacaaatgacctaaataatcattaccattaatagttataatactctttcatagaaaagaaggtaggcttgtgcactaagtgctcttgattctggaaccacctgtaagtaagtgtcactaacatggacccactggcctgctgattcattatcagccgctttcaaacctagcaaaacaaaaagaagtacaattttaaagtaagtatgctttaggttcttactctaaattacaaacaataacatattcattacaaactctatctaatgccaaattttacctgagaagcctgttttttcttgggttaagcattttccaaaaagaacttttttttttttaaattatatttttaagttctggaatatctgtgtagaatgtggtttgttacataggtatacatgtgccatggtggtttgctgcacccatcaacctgtcatctacattacgtatttctcctaatgctatccctcccctagcccccctcccccgacaggcccagtgtgtgatgttcccctccctgtgtccatgtgtactcattagaacaaattctttcaaagcattaatattataggtataattaataatgctgtctggcccagcgcagtggctcatgcctgtaatctcagcacttggggaggctgaggtgggtggatcacttgaggtcaggagtttgagaccaacccagccaacatggtgaaaccccgtctctaatttaaaaaacaacagacattagccgggtgtggtggcaggcgcctggagtcccaggtacttgggaggctgaggcaggagaatcgcttgaacccggaaggcagaggttgcagtgagccgagatcctgccactgcaatccagcctgggtgacaaagtgagacctcatttcaaaaacaaacaaaaaaagcaaagttagttggatgacccataaacaaagccagcaaattttcaactccaactcttctgacaatctgatatggcttcaaaaacttttggtattgttaaataaaatgctactccactataatacacaatgactcagtaccttaaaataccatgtcatctcatatgacctagaagggtacagtcttcataatatttgagattttctaggcactcctagagggaattcttaaggtgaatccagttgaggctgggcatggtggctcacacctgtaatcccagcactttgggaggccgaggcgggcaaatcacttgaggtcaggagtttgaggccagcctggccaacacggcgaaaccccgtctctactaaaaatataaaaaattagtcacgtgtggtagcacgtgcctgtaatctcagctattcaggaggctgaggcataagaatcacttgaacccaggagacagaggttgcagtgagccaagatcgtgccactgcactccagcttggatgactgagactctgtctcaatcaatcaatcaatcaatcaattaagttaaaataaagcaagcaagcaaatccactagaggcatctatgaaataataacttagctctcccagaaaaggaagcacatattcgtttgtttttaagaataaaataaacttaggatggcataccaggcacatttttctttttagtgttatgttccgataatttcctggagggtgttctcactttcacataagcagtgtagtggccttctctcatcgagccactatgttccactatgccatagagaccgtagagaactttatctcccacacttgcattcttttaaacaaagaaaaaaacccaaattagtaatatttgttaaatactgttttaaggaaaagtaagtaaatgtatatctgcttaacataagaaaaatgcatagtaaaactgagatactttccatacttactaggctggcaaaatggaaaaaccttaacaaggttctctgttggctgatttgtggggaaaagagcactcacacatattgcacatgggaatgcaaagggtacaatccctatgcagggatgtttctttttttctctctctctttttcttgagatggagtctcgctctgttacccaggctggagtgcaatggtgtgatctcggctcactgcaacctccgccacccaggttcaagaaattctcctgcctcacgttcccaagtagctgggattacaggggtctgtcaccacgcccagctaatttttgtatttttagtagaaacagggttttaccttgttggacaggctggtctcaaactcttgacctcaggtgatccacctgccttggcctcccaaagcgctgggattacaggcgtaagccactgagcctggcctatgcagggatatttcatgttatcaggctaagttctgtatgtattactcttggattcattaatcctttttctaggatttgatcccacaaatacatgagcaaaatgtcaaaagacatgtaccacactattaattgcaggattatctgtaatatcaaaacacgaattaaaatgtctataaattggggactggttgaataaactatgatgcatccacacaatagagtattatgctgcttgaaaaatggagtgtagactatctctaaatggtgctatggaataagctgtaggatataatgttaagagtaaggcagaaaaaaggatacacagtgtcagctaccattatttaagaggggagatgaaaatatacatgcctgtctgcttatatttaaaaaaaattataaaagaataagccataatttttaaaatggttacctataaggggaaggagcaaacaggtagaatgtcatggagaaaagccagatatctttcaatttaccttatttaggtacatttgactttggacctatataaatatgttatgtaattattaaacaaaattaaattttaaaagaaattccaaaaagtgaaaattaaaaattgcacaaatgaacaatagatccagtccttatctggataataattgattttaaaaatcacatttatgagacaattgaaaatatgaacactaggtgatatgacagaattattaaatgatattgtggttatgttaaaaagtgtagagggagcaattcttatctgttagagatacatagtgaaatattatgggtgaaatgattcctgatgtttgcttcaaaataataaaggagaagaaagtgaattagtgtgtggatagggcaggactggccatggatgtaaggttttagggctgggtgctggaagttcatggtactgttctatttgcttttgtgtttattggaaattctccgtaataggtactttttaaaaatatgttttcataagtttaacacaaagattgttaaatttcattattatttaccacattattaaattctaggaatactgagtattaacaattgacagatagtgctggtattccacagcagatacactgtaattcaaccaaaaattgcatttaagatgattttgttttgattatcaatgtgctgaaagtattaagttcaataagcattctattacatactacaaaatctagacttctagccagtaatcatgaacaggacagtatgttaccccataactgcttccttcaaggaagaccaagtcatctacttcatctacacaattcttacatgtaaaataagcaatgataagccagtctgctttctgtacctaattattaaagtagcagcagttttgaagtatcacactccgctgacaagtacaccactctcagtagtacacatgaagtggcacgaaagacaattcacttctacactgatttgcaaaagatacagaactccgcaaatggtaaaactactactgattaaacagttcacaaggaacaatcgaggacacaaaacctccttctctcagcaaccatcagcttccagtagcacttacaaacagcttagaccttcataaccatcatgcctcatgccttaccttttcaattttcctttgtctcccaaaggacaaaaatcatattcaatgtattaagtgttccacatattactgacttaatcactggctattaaaattccctttcagaagagaagttatttttttagaaaaagcattgtctaataatatataggatactttcaagcatattaatttataaatcaattaaatatcttaatatactgtaccttacaagtagcagagcagaatggtgctaaatcgagcataagtggaaaatctacatgtctgtttactttacgaagactcaagccagccttaaaaagaccaaaacatttttgaaatgcaacaattagaaataaagcattgtctttgttaactaaaaccaaaagagaaattgtaggacttagttttttcatagataaaaaatgtgactaatgtatagtctaaaattaatatgaataaattaaaaattaggtttcataaattgttactgcaaagattattcatttacatggggatttttaccacaaacaatagggggaatagttactttcattatggcttttcaacacttatggaaaaataaattcaatataaaagctaagctactgacacatatgctatcatgaaaatatattcaactaaagagtaaacagattggtgttctaggcctaactcagtgactggttgtcaacttgattccatatataaaaggatgagattaggtccttttcagttctaaaattcaattatattcattcattaaaacaaacaacctgaacactcaaaacattttatcagtaaaagtaaatgctatatattacatcaataaaattgtacttttatgttcttaaatatgctctctttttctaattttcaaaggcaaaccttaaaaagtatatgctttgcattatgtaatggtaataaaaactagctaataaaatatcaaaggtattgaggagacccataaatagaaatggactctgttggaatgaaaagatacctaaatctgaaatgaatgggtagacaaaaacgaaaaggggcaacctgtcatgacgtcaatgactgatctttcatttgcatactaatcacaagtttactgtagatctgttgcttttttatggcttatctttctttaaaaacaaaaaaccctttttttttgccgaagtgtattcacctactgatttgttttttcaagtgatctttagaaggcttgaaaatagctgacatgaaattatgacatcatatcccaggaatatttaatctacattcaatttctttgcctttttcatcaggtgacctctataagcacccaataccagcactgtctgagatcatttcagctattgtgttctcctcaatcagtactttgctgttgagaaactaccccatcatacaagagactgtgtgaaggactttaatataagatgaatctttttttaggtggtaatttttggaaaatatctagacttatatttgcatatacagtctcctgcctttttccctttaatgaaatgatacactgcattttccatattaaaatataaatttgatatcctgcacattggacatttaagctaggccttacgtctggcatgatctgagtggggcacacacaaatttttgtgtatatctatttccttgtggtagattcttagtcaagagtaattagctttgttcaaaaattgttttgtttaaaacattactcggccgggcacggtggctcatgcctgtaatccaagcactttgggaggccgaggtgggtggatcacctgaggtcaggagttcaagaccagcctgactgacatggtaaaaccctgtctctactaaaaatacaaaaattagccaggtgtggtggtgggtgcctgtaatctcagctattcaggaggctgaggcaggagaatcacttgaacccaggaggcggaggttgcagtgagccgagatcgcgccattgcactccagcctgggcgacaaaagcgaaactccatctccaaaaaaaaaaaaaattactcaatgttcttcatattcattactaaattgctttctagcaggtgttaccaacttacactcccaatgctggtaaatgaaaatgtctctatctcagttcatccttatcaacactactacatctttgctaatttggacaggttgaaaaaagaatctgccattttattttgcctttcttttgctgggaaggatggacctttttcatacttgcctggactttgtacttctagaaatgtcagttgatattcttttcccattttactattagggtctgatatttttcttattgatctttaagactctttatatacttacaatattaaaattttggcatatttatgacaaagatctctattcagtttcagatttgcatttaagtgttgtggatgtttctgatatacagccctaaagctaccatagagaaggcgttcagggatgtcaatgaactagaaacacaggcattgcttagggactctgctccctacaatgcccaaaccctgggaataagaatgtggctttgctgacattacatttagcttgagagaaaaagggacctagatggatgtccataaatatttccctttaagggcaagaattatttctgtaagttgtttctaaacagggatgcaagtaccaaatataaaataactgcggtgcatcatgaaattagcttctgcaatctggcattatcctctcttattcacacagaatcactgcagatgtaccctttccattaggcgctctgatatgacaagacataatacatctgcttctgttctctgtgtcatttcagttccattgagcttctacaaccttggctatggaagaattcagaacttaatctaatctgtggatagggatggcaggatggagaaaaatctcctctcgcacatctggatcccacctaaaatgttgcaaatatgtaaactatcaatagttttccttgagatttccttcttaaggttttatatttagaaagtctttcacacagaggtcaagttaaatattcatttaagggccaggtgcagtggctcacgcctaaaatcccagcactttgggaggccgaggtgggcggatcacctgaggtcaggagtttaagaccagcctggccgacatggtgaaaccccatctctactaaaaatacaaaaattagctaggtgtggtggcacacacctgtaatctcagctacttgggaggctgaagcaggagaatcgcttgaacccaggagttggaggttgcagggagccgagattgtgccactgtactccagcctggcaacagagggagattctctcctctaccctcccaaaaaaattatttaagttttctccttgttttcttgataatttgttttatacaattaagatttttatttgaaaattgtatgggctgggtgtggtggctcatgcctgtaatcccagcactttgggaggcccaggcaggtggatcacttgaggtcaggagttcgaaaccagcctggccaacatggtgaaatcctatttctactaaaaatacaaatattagccagtgtggtggtgggcacttgtaatcccagctatttgggaggctgaggcaggagaattgcttaaacccgggaagtggaggttgcagtgagctgagattgtgccactgcactccagcctgggtgacagagcaagactcttatttccatctggtctcgaactcctgacctcaggtgatctgcccacctcagcctcccaaaggccgagggagccaccgtgcccagccacaaaacttattttctattaccacacaaacacacacagagataccatttaggttcctgctgcctaaattttcaaatattgtgaattaaacaattttaatcaggaaagtcttataaactattatggctagatgagcagtaaatctcacatgacacattttaaaatgcaataagttactggttattgtctaattcttgacaatattctataggacttaatgctctgtaaaacacatgatgaaaattatggtgctactgaagaaacttacctgatgaaatcttttcaggtggagaattaggacagctggaacagcagaaatgagcaattgcttcctggcattagtataaactccttctactttcttttctacataaaatacaataaatttatttataaaattccattttatacattatctaccatataataaaaatttatacagaagtatcataccacatttttaaaaatgttaaagaaattggacttctgatgaaaggacagtctttactccttcctaaaactctgctaaaatgaaagtaaaggaattttttttaaggcacacagttaataagaacaaagaataggagaggtaacacgaaacaaaattttggaaggtagaaagcagatggactagaattaatttctgtcaatgccctccagccaaaaatcaccagaagcacgtgtagttgaagaatttgggtttaaaaagatttctagatttctaattttttttttttcttttgagattgctgttacccaggctgaagtgcagtgaggtggtcatggctcactgtagccttgacctcccaggcacaagcaatcctcccacctcagcctcccaagtagctgggactacaggtgcatgccaccccacctggctaatttttaaaacgttttttgtagacatgggatctcactatgttcctcagactggtcttgaactcctggctacaagcgatcctcatgccttggcctcccaaagtgttgggattacaggtgtaagccactgtgcccagccccaatttctaaattcctaagatttatgttagtatttgaacattgccaattgcatataggtatttcttccttctcccatttctttattactagtgtattaagtatgtctttattctgatgctttgacatctagggtctggttaacattggagggacaacccctcccagggctaattcctagagatagtaaacaacttacatatgcatgcctgtcacatgcaaaccaatccagagcccagagcgcataccccaacaacctccttcactgggctcttacactctgggacactatccacttgctgtaatcactctaggaccaggcacctgataactagagacagctcctatatcccagagcccactaatattattcaaactagccaatcctaagcctgcttagcctgccttacccatttcttcctttagaaatcacactaaaggctcctgcccatgttttcccctcactcccctacctcctgactgacgctggtgcttccctgtgtggtcctgtgcagcatggtgggcccccacttcttgggaactatgaataacacactatttcttcagtggcaattatctcctgatcttttagcctcaccgtacctgaataataaagcctacattttaaaacaagtagtcactaagaatcagagtattctttccatttactcaaggataaagatgaactgaaaatttcttattttccccctttctccacttctctctgaccaactaatcatggtaattatagcgctagctttatgacatgctactatttaaaatcttcaaaatttatcttacgttgagtttacaacagattgataggatctgtgaaacacattagctttatcatttatcttaccagtgatacaattagaagttttagggaggccaggcatggtggctcacacctgtaatctcagcactttgggaggccaaggcgggtggatcatgaggtcaggcattcaagaccagcctggccaagatggtgaaaccccatctctactaaaaatacaaaaattagctgggcatggtggtgggcgcctgtaatctcagctactcaggaggctgaggcagaataatcgcttgaactcaggaggtggaggttgcagtgagccgagatcgcgccactgtactccagcctgggcaacagagtgagactccatctccaaaaaaaaaaaaaaaagttgtagggatatttcttctggatagatttcagataggtagttccctcaaataagattatatgggtttgcattttcaaggcagagttgtatacttcctgctctttatttaaataaaaaaacttgaaaatctgttctgcccagtattgtaagcgctcaggtacaaatatgaatgaaacaatctctgcctaagtaacacaagtatagggacaagattctcagtaaaattctcagtgaaatttgtaactcactagacactatcaggagatcaataattatgtaattaaaaaaataattacctgcaaaactggtttcttcttggtacttctgtttgtttttagtacaattctcacatagaagcttattattccccattagtaattccatagatgtaaactggtagagacaggactgaattgaacattctttagaagtagttatatagctctgagaaagggtctgaaaagcattttggggactataagacctcaaatgcttcccctctaaaaaacataaattatttgaaatatttagtggctgattttctctgtcaaaatcttgatctccagttacagtgctgctcaaacgaagttcagaaatagcttctgccatttccttatcaccactgtcagtctccttggtgtacagcagtttacctgctgacagagggtaaaggggtccatctggctgcacaccggatccactactggatctgaacagcccagtctgctttgaagcactttcagattctgaaggctcactgtcagcatcaacattgctttcagaatggctggcttctttttcactgtcatcagtagggctttcattcagacgtgactcagaattcatgaggctggcaaacattaaagaatccccattcatttcaaggttttcatttttctggtatgtgacagtttctccagatgacaattttctaatacattttcggtcatgaattagttgactctgtaagttgacagtgttttcaaagaaaagagtcttgtaacctcattgaaaataaatgccaataattcttaaacatatcatagttattaaataccatttctctcagatccatttcctaagcctactgaaactaagatcactagaagatatactaaaaaatagttctattttaaaagtaaatcttcacacaagaaactaacaacagtgtaacagaggctatttgtggggaaggaaataggacttttgtagaacagggctatgagggagacttttttctttaaaagaaaaatctcttttagagacagcatcttgctctgttgcccaggctagagtgcagtggcacaatcacagctcaccgcagcctcaaactctcggactcaagtgatcctcccacctcagcctcccatgtagttactactacaagtatgtaccaccatacctggctaattttttaattttttgtagagataaagtctcgccatgttgcttaggctggtcttgaactcctgacctcaagcaatcctcccaccttggcttcccaaaggagacttttcagttactgtataagcctttccatacttgttcatttttaaacactgaaaatgtatctgttttttaaacaaattaaaaagtaacaaaagtaaactataaactattatgacacagtgttgcttggttgccatagatctggaagaaaattacgggaaaaaaataacctaagtttgggaaggggggaatcaactaattaaaaattttaagctacctgaaatgtttcactaaagtttccacacagctgatggcttgaagtacatttttcttttcctataccttggctgaagggtcaagacaaaaaataaagaaaagactatcatgagtaattgatactcagttttagttattcaggggaagaagagtaagttataaaaagtgtcttgcctcaattttttttatctgcaaaatcaggaaaaataacattagccaacaagttccactccgctgaatttatatagtacttttttttggaaacaaactttcctattatacatataatactaacagttggtaaacaaagcggccggccaggaagctcgaactgggtggagcccaccacagctcaaggaggcctgcctgcctctgtagactccacctctggggtcagggcacagcccaacaaaaggcagcagaaacccctgcagacttgaatgtccctgtctgacagctttgaagagagtagtggttctcgcagcacagagtttgagatctgagaacggacagactgcctcctcaagtgggtccctgacctccgagtagcctaactgggaggcaccccccagtaggggcacactgacacctcacacggccgggtacccatctgagacaaagcttccagaggaacgatcaggtagcaacatttgctattcagcaatattcgctgttctgcagcctccgctgctgatatccaggcaaacagggcctggagtggacctccagcaaactccaacagacctgcagctgagggtcctgactgttagaaggaaaactaacaaacaggacatccacaccaaaaccccatctgtcagtcaccatcatcaaagaccaaaggtagataaaaccacaaagatggggaaaaaacagagcagaaaagctgaaaattctaaaaatcagagcgcctctccccttccaaaggaacacagctcctcgccagcaacggaacaaagctggacggagaatgactttgacgagttgagagaagaaggcttcagatgatcaaacttctcctagctaaatgaggaagttcgaacccaatgcaaataagttaaaaaccttgaaaaaagattagacaaagggctgactagaataatcagtgtagagaagtccttaaatgacctgattgagctgaaaaccatgacaggagaactacgtgacaaatgcacaagcttcagtagccgatttgatcaactgcaagaaaggatatcagtgattgaagatcaaatgaatgaaatgaagcaagaagagaagtttagagaaaaaagaataaaaagaaacaaagcctccaagaaatatgggaatatgtgaaaagaccaaatctatgtctgattgctgtacctgaaagtgacagggagaatggaaaacactctgcaggatattatccaggagaacttccccaacatagcaaggcaggccaacatgcaaattcagcaaatacagaaaacgccacaaagatactccttgagaagagcaactccaaaacacataattgtcagattcaccaaagttgaaatgaaggaaaaaatgttaagggcagccagagagaaaggtcaggttacccgcaaagggaaacccatcagactaacagcagatctcttggcagaaactctacaagccagaagagattgggggccaatagtcaacattcttaaaagaattttcaccccagaatttcatatccagccaaactaagcttcataagtgaacgagaaataaaatcctttacagacaagcaaatgctgagagattgtgtcaccaccagacctgccctacaagagctcctgaaggaagcactaaacatggaaaggaacaactggtactagccacagcaaaaacatgccaaactgtaaagaccatcaatgctaggaagaaacggcatcaactaacgagcaaaataaccagctaacatcatgacaggatcagattcacacataacaatattaaccttaaatgtacatgggctaaatgctccaattaaaagatacagactgaaaaactgcataaagagtcaagacccatcagtgtgctgtattcaggagacccatctcacgtgcagagacacacatagactcaaaataaaaggatggaggaagatctaccaagcaaatggaaaacaaaaaaaggcaggggttgcaatcttagtctctgataaaacaggctttaaaacaacaaagatcaaaagagaaagaaggtcattacataatggtaaagggatcaattcaacaagaagagctaactatcctaaatatatatgcacccaatacaggagcacccaatacaggagcacccacattcataaagcaagtccccagagacctacaaagaaacttagactcccacacaataataatgggagactttaacaccccactgtcaacattagacagatcaatgagacagaaagttaacaaggatagccaggaattgaactcagctctgcatcaagtggacctagtagacatgaacagaactctccaccccaaatcaacagaatatacattcttctcagcacatcacacttattccaaaattgaccacacagttggaagtcaagcactcctcagcaaatgtaaaagaacagaaattataacaaattgtctctcagaccacagtgcaatcaaactagaactcaggattaagaaactcactcaaaaccgctcaactacatggaaactgaaaaacctgctcctgaatgactactggttacataacgaaatgaaggcagaaataaagatgctctttgaaaccaatgagaacaaagacacaacataccagaatctatgggacacatttaaagcagtgtgtagagggaaatttatagtactaaatgcccacaagagaaagcaggaaagatctaaaattgacaccctaacatcacaattaaaagaactagagaagcaagagcaaacaaattcaaaagctagcagaaggcaagaaataactaagatcagagcagaactgaaagagatagagacacaaaaaaaaacccttcaaaaaatcaatgaatccaggagctggttttttgaaaagatcaacaaaatcgataaaccactagcaagacaaataaagaagaaaagagagaagaatcaaataggcacaataaaaagtgataaaggggatatcaccactgatcccacagaaatacaaactaccatcagagaatactataaacacctctacgcaaataaactagaaaacctagaagaaatggataaattcctccacacatacaccctcccaagactaaaccaggaagaacttgaatccctgaatagatcaataacaggctctgaaatagaggcaataattaatagcctaccaatcaaaaaaagttgaggaccagacggattcacagccgaattctaccagaggtacaaggaggagctggtaccattccttctgaaactattctaatcaatagaaaaagagggaatctttcctaactcattttatgaggccagcatcatcttgataccaaaacctggcagagacacaacaaaaaaagagaattttagaccaatatccctgatgaacatcgatgcaaaaatcctcaataaaatactggcaaaccaaatccagcagcacatcaaaaagcttatccaccatgatcaagtgggcttcatccctgggatgcaaggctggttcaacatatgcaaatcaataaacgtaatccatcatataaacagaaccaaagacaaaaaccacatgattatctcaaaagatgcagaaaaggcctttgacaaaattcaacagcccttaatgctaaaaactctcaataaattaggtactgatgggacatatctcaaaataataagagctatctatgacaaacccacagccaatatcatactgaatgggcaaaaactggaagcattccctttgaaaactggcacaagacagggatgccctctctcaccactcctatttaacaagtgttggaagttctggccagggcaatcaggcaggagaaataaataaagggtattcaattaggaaaagaggaaggcaaattgtccctgtttgcagatgacatgactgtatatttagaaaaccccatcatctcaacccaaaatctccttaagctgataagcaacttcagcaaagtctcaggatacaaaatcaacgtgcaaaaatcacaagcattcttatacaccaataatagacagagagccaaatcatgagtgaactcccattcacaattgcttcaaagagaataaaatacctaggaatccaacttacaagggatgtgaaggacctcttcaaggagaactacaaaccactgctcaacaaaataaaagagaacagaaacaaatggaagaaccttccatactcatggataggcagaatcaatattgtgaaaatggccatactgcccaaggtaatttatagattcaatgccatccccatcaagctaccaatgactttcttcacagaattggaaaaaactactttaaagttcatatgggaccaaaaagagcctgcatttccaagacaatcctaagccaaaagaacaaagctggaggcatcaggctacctgacttcaaactatactacaaggctatagtaaccaaaacagcatagtactggtaccaaaacagagatatagaccaatggaacagaacagaacccgcagaaataataccacacatctacaaccatctgatctttgacaaacctgagaaaaacaagcaatggggaaaggattccctatttaataaatggtgctgggaaaactggctagccatatgtagaaagctgaaaatggatcccttccttacaccttatacaaaaattaattcaagatggatcaaagacttacatgttagagctaaaaccataaaaaccctagaagaaaacctaggcaataccattcaggacataggcatgggcaaggacttcatgtctaaaacaccaaaagcaaaggcaacaaaagccaaaattgacaaatgggatctaattaaactaaggagcttctgcacatgaaaagaaactaccatcagagtgaacaggcaacctacagaatgggagaaaattttgcaacctactcatgtgacaaagggcaaatatccagaatctacaaagaactcaaacaaatttacaagaaaaaaacaaccccatcaaaaagtgggcaaaggatatgaacagacacttctcaaaagaagacatttatgcagctaacagacacatgaaaaaaatgctcatcatcactggccatcagagaaaagcaaatcaaaaccacagtgagataccatctcacaccagttagaatggtgatcattaaaaagtcaggaaacaacaggtgctggagaggatgtggagaaataggaacacttttacactgttggtgggactgtaaactagttcaactattgtggaagacagcgtggctattcctcaaggatctagaactagaaatgccatttaacccagccatcccattactgggtatatacccaaaagattataaatcatgctgccttaaagacacatgcacacgtatgtttattgtggcactattcacaatagcaaagacttggaaccaacccaaatgtccatcaatgatagactggattaagaaaatgtggcacatatacaccatggaatactatgcagccataaaaaaggatgagttcatgtcctttgtagggacatggatgaagctggaaaccatcattatcagcaaactatcacaagaacaaaaaaccaaacactgcatgttctcactcataggtgggaattgaacaatgagaacacttggacacaggaaggggaagatcacacacaggagcctgttgtggggtggcgggagcagggagggaaagcattaggagatatacctaatgtaaatggcgagtcaatgggtgcagcacaccaacatggcacatgtatacatatgtaacaaacctgcacgttgtgcacatgtaccctagaacttaaaaaagaaaaaaaaaaaaacataaaaggcatccaaattggaaaagaagtcaaattgttcctcttcacagacgacataatcttacatataggataacctaaagacttcaacaaaaaactcttagaactgataaacaaattcagtaaagttgttgaatgcaaaatcaacatatgaaaatcagtagcgtttctatacactaacaacaaagtagctggaaaaaaaaatcaacaaagcaatcctgtttacaatggctacaaaagaaaaaaaaattccacctaggaataatttaactgaggaggtgaaagacctccacaaggaaaactataaaatactgatgaaagaaactgaaggagacacaaacgaaaaagcatcccatgctcatggatcaggaaaatattaaaatgactatgctacccaaagcaatctatagactccatgaattcctatcaaaattccaatgacgtttttcacataaaaagaaaaaacaatcctaaaatatgtatggaacctggctgggtacagtggctcatgcctgtaatcccagcactttgggaggctgaggtagatagatcaactaaggccaagaatttgagaccagtctggccagcacggtgaaaccccatctctactaaaaatacaaaaaattagccaggcatggtagcaggcacctgtaatcccagctacttgggaggctgaggcagaagaatcgcctgaacctgggaggcggagactgcagtgagctgacattgcacctctgacagtggcactctggccttggcaacaagagtgaaactccatctaaaaaaagaaaaaaatttgtatagaaccaaaaaagagccagaatcactaaagcaatcctgggcaaaagggagaaagctggaagcctcacactacctgacttcaaaatgtacaagactacagtaaccaaaacagtatggtcatggtataaaaacagacacatagaccagtgcaacagaataaagaaatccacatacttacagccaactgatttctgacaaaggggccaagaacaaacactgggggaaggacgccctcttcaacaaatggtactgggaaaactggttatccatatgcagaagaatacaactagaatgttatctctcaccatatacaaaaatcaactcaagatagataaaagacttaaatgtaaaatctagaatataaaaccacaagaagaaaacataggagaaacactcaggacattagtctaggtaatgattttatggagacctcaaaagcacaggcaacaaaaacaaatgggactacactgtaaaaagcttctgcacagaaaaggaaacaatcaacagaatgaagagacctcctgttgaatgggagaaaatatctgcaaactcttcatcctataaggaactaatgttagacatttcccaaaagaagacatccaaatggccaagaggtatatgaaaaaaatgctcaacatccctaatcatccaggaaatgcagattaaaaccacaatgaaatatcattttaccccagttgaatggttattatcaaaaaagacaaataataagatgccttcaagaatgtggagaaaaggagtctgaaacacggttggtgggaatgtaattagtacagccatcatagaaaacagtatggagatggctgggtgcagtggcttatgcctgtaagctcagcactttgggaggccaaggcaggtggatcacgaggtcaagagttcaagaccatcctggccaacatggtgaaaaccctgtctctaccaaaaatacaaaaaaataagcccggtgtgatggcaggtgcctgtaatgccagctactcgggaggctgaggcaggagaatcacttgaacctgggaggtggaggttgcagtgagccaagatcacaccactgcactccagcccgggtgacagagcgacactccatctcaaaaaaaaaaaaacaaaaaacaaaaaaacaaaacacaacagtatggagatttctcaaaaaactaaaatagggctgggtgcgatggctcacacctgtaatcccagcactttgggagactgaggtgggtagatcacttgaggtcaggagtttgagaccaccagcctggggaacatggtgaaaccctgtctctaataaaaatacaaaaattagctgggcgtggtggcacatgcctgtagtcccagctacttgggagatggaggctgaggcatgagaatcacttgaacccaggaggaagaggttgcagtgagctgagactgtgccacagcacttcagcctgggcgatggagcgagactctgtctcaaacaacaacaacaacaacaacaacaacaacaaactaaaatataactaccataagatccagcaatcccactactagacatttatccaaagaaaagaaaaccagtgtatcaaaaggatacttgcacccccatgtttactgcagtgctattcacaatagccaagaaatggaatcaatctaagtgtccatcagtagatgaatggataaagaaaatgtagtatatatccataatggaatactcttcagccctaaaaagaatgaaatcctgtcatttgcatcaacatgggttgaactggaggtcattatgttaagtaaggcaagctaggcacagaaaggcaaatatcccatgttctcactcttatgtgagagctaaaaaaaaaaaaaaaaaaaaaaaaaaaaagttggggcaggcgcagtggctcacacctgtaatcccagcactttgggagactgaggcgggtggatcatgaggtcaggagatggagaccatcctggctaacaaggtgaaaccctgtctctactgaaaatacaaaaattaaccgggcttgatggcgggcacctgtagtcccagctacttgggaggctgaggcaggagaatggcatgaacctgggaggcagagcttgcagtgagccaagatcgcgccactgtactccagcctgggcaacagagcgagactctgtctcggaaaaaaaaaaaaaaaaaaaaaaagatctcatgaaagtagagagtagaatgatagatatcagaggcttagaaaagagtgagtggggttgtagtggagaagctaaaaagagaggtatgttagtgagtacaaagacagagttagaaggaatagttctaatgttccatagaacagtatggtaactacagttaacaacatagattacatatttcaaggtagctacgagaaaatctgaaatgttctcaatgcaaagaaatgataaatgcttaaggtaactgatatcccaaataccctgactactgtgggaagtcagggaccccaaatggagggaccggctgaagccatggcagaagaacgtggattgtgaagatttcatggacatttattagttccccaaattaatacttttataatttcttatgcctgtctttactgcaatctctaaacataaatcataaagattgcatggacacttatcacttccccaatcaatacccttgtgatttcctatgcctgtctttactttaatctcttaatcctgtcagctgaggaggatgtatgttgcctcaggaccatgtgataattgcgttaactgcacaaattgtacagcatgtgtgtttgagcaatatgaaatctgggcaccttgaaaaaagaacagaataacagcaattgttcagggaataggagagataaccttaaactctgacctctggtgagctggcggaacagagccatatttctcttctttcaaaagcaaatgggagaaatatcgctgaattctttttctcagcaaggaacatacctgagaaagagaatgcgtgcctgggggtaggcctatgaatggcccccctgggcgtagccgtctcttatggtcgagactgcagggatgaaatagaccccagtctcccatagtgctcccaggctcattaggaagggaaaatacccacctaataattttggtcagaccgggtgctctcaaaaccctgtctcctgataagatgttatcaatgacaatggtgcccaaaacttcattagcaattttaatttcacctctgtcctgtggtcctgtgatcttgccctgcctccacttgccttgtgatattctattaccttgtaaagtacttgatgtctgtgacccacacctatttgcacactccctccccttttgaaaatccctaataaaaacttgctggtttttgcggcttgtggggcatcacgtaacctaccgacatgtgatgtctcccctggacgcccagctttagaatttctctcttttgtactctgtccctttatttctcaagctggccgatgcttaaggaaaatagaaaagaacctatgtgaatattggggcaggttccccgatacctgacttgatcatgatacattctatgcatgtatcaaaatatcacatatacctcataaatatgtacaaatattatgtaccaacagaaaattaatggtcaatggaaaatatagacccatacaggtttttagtaacttgtccaagatcatataactaataaaaatagctgtgtccagaatccaattaatctaattctgattgaatagtttccaaattcaggtgattatcagactcacctaagagggcttgttgttttaaaagatacatatccgaggcattaccactaagaaattcccattaatcatgtctgaggttgggtatgagaattcgttttaataaacaggtgattctcatcatcagctggtcttaggaacttttgaatgagactattctatctatcccttttatcctcctactcctagtgaaatataaaagtaccccttcccatccttattttttgagactatagaaaagcccacagagcagtgcgtagcccacagtaagcagcgtaagtatcagctattattactattagtattattttgagatggagtctcgctctgttgcccaggctggagtgcagtagcgcaatctcggctcactgcaacctccacctcctggtttccagagattctcctgcctcaacctcccaaggagctggattacaggcgtgtgccaccatgaccggctaattttttgcatttttagtagagataaggtttcactgtgttagccaggatggtctccatctccggaccttgggatctgcctgcctcggcctcccaaagtgctgggattacaggcgtgagccaccgcacccagccagtatcagctattacgattggcagcaatcatgagaatgagctcagtggtctccctaaacaccatccatgtacaagcactgaactaggcacctgagacatagtggcaagaaggacagactcagttcctgtttgcagatcctgcaatccatcccaataaaagtatggtgagacataagttcaagtcagcagggggcagtatacgtggttaagaacatggtccttgtttaacctgtctgaatccccatttctgccagactacttgtatgatcttaggcatgttatttaatccacctcttggctcaatataattggtgtaaataactgaaaacagtgatcataacataattaagaactcaaatgttaggtacaacttatgttatgataggagaaatacagtgctatagaaagccagaggaaaagaactaatccagaattgagtggatcagagaaatatgcagaaattgagcagaggctacaggaggagaatgggactgttcgtggcagaagagacagttcaaaggcccacaggtaagacaaagaacaagaaattagggaagtctagctagaaaatagagtacaagtgtggggaggtgagaaggacacacaaaaattaaccagatgcatataagtcacagacttgtttttgttttgaacagcaatgagatttattttttcaacttttattttaggttcagggtacatgtgcaggtttgttataaaggtaaacttgtgtcacaggggtttgttatacagattatttcttcacccaggtactaagcctagtatccaatattattttttctgatcctctccctcctcccaccctgtgcaccctccagtaggccccagtgtctttgttcccttgtgtacaagtgtactcaatgtttagctcccacttataagtgagaacttgtggtatttggttttctgttcctgtgtgagtttgctaacgacaatggcctccagctccatccacgttcctgtaaaaggcacaatcttattcttttttatggctgcatagtattccatggtgtatatgtacaacattttcttatccaaactgtcactgatcagcatttaggttgattccatgtctttgctattgtgaatagtgctgcaatgaacattcacctacatgtgtttttatggtagaatgatttatattccttcaggtatatacccagtaatggaaatgctgggtcaaatggtagttctgtttttagctctttgaggaatagccacactgctttctgcaacggttgaactaatttatacttctaccaacagagtataagcattccttttctctgcagcctcgccagcatttattttttgactttttaataatagcattctgactggtgtgacatggtatctcattgtgcttttgatttgcatttccctaatgattagtgatgctgagtttttcatatgcctgttggctgcatgtatcagacttgattctgagggctacaaggaatatgatgacctatttttgtattttagaaatattgccctgtctgcaatgtggagcaccaaatggtggtggggaatagggagaggagtggggtctagggaaacaaaaaattaatcagatggctacatgataattccctatcttttccctcagaccttttgggtagtgctttttttgcctcacataattttccaataaaaaatttctattcactgtttcctttcactattttttaaactttctaaaatactcaggccagatctgttgcctttccaccagtgctaactttcatttgtattcacattaccatatcttggttttatttctccttttttccttacctgatgcttatcatccttcatattaaactttgttcagttttaatgagataactgtagtataatttagcaaagagaagtgaaaaactcaatttactatcaaatcagtacttgtacctctattattaaaagatgcaaggagcttctctttttgttacagacactaagtagaggggaaaagcccacttttaaagtttaaaaatataagaaatgaaaatgatcaaaggggagatatatgaccttctctgggtgtttccaaaattcccaagagtaaattgagccaacaccacatgataaacaaaaatatccttgcaactgttttacttggactttaaaactactaagtacctgttcaattttatccttaaaaaaatttacataggttaagttgccattttctcaaatatctctgtataataccttgagcaatttagcacctaggaaaaatggtaaaatcaggtaagatcccttcgaatacagcgttttcctcaaatctattttgaagtatattgatagataccgtaactacacagtattcttttggtgactggtctgattggtaaaataatagaaagattgaaattttcttaatttcttccatgtaaataagaggactatgattttctgaatataaccccaatgatgagaggcacaacacaggtttcagcaattccataataacaccttttataataactaaaaagaaaacagaggaaataagatggaacacaaaaattattcaattaaaaccaaaagtgcatgaaaagtagaaacagaaataaacaacagatgggatgtatagaaaaaacagcaagattctggtcttataattgaatttaagagccgagtctcaaagagcttaattggcaaaacgctgcgcagctaacaggtggtgggaaccaaagttcatgtaaattgtaccagagcacaatgcacttctgattctggcagaagtattaaggttttatgaaataaaaaaaaaatctttcataaaactaatatacttatgtgttgaagcaactcagagaactgaacttttggatttctttctgaactaatgagctgaggcaggattttatataaggatatcaatttgagattttccagtctctacaattattcaatcagcatgatggttttttaaaaagctgtggggaggggaaagaagggaagaaaaatagcctatggaatagacttcacataatatcttttggtagccatttgttgcagctcattttaccttagtttttggttcaagaaggatgtttatataggcctatggctatttactctgtttacgtatctgcctcctgttactattttttctgtatttaggccagaaattgcacacactagttttacagtgctttatttaactggattatttgcctgttatcagtaagcaaaagaaaatgcactttttcaaggtactcagagataacatcttccaacttgagggcaagattttctcagctaatttcactatttttatgtaattatttttatcattcttcatattaagtttttgtgtggttttaatgagataactcatataatttggcaaacagaaaaggtaaaaaactcaaaaacttatgatcaaatcagtacttgtgcctctagtataattttaaaagatgcaaggtgcttctattactgtaagagattaaaaaatactataaagtttgtcacaaatatctttatactcttattaacagcttcactaatcagcaaaacaagactttattgatctttataaaactagtactgaaagtagttaactactgaatcattctggttccatgattaaactggttctgtagttgaactattggaaataacttctaaacgtaaacttcctaatgactgaaatacatttatgtcatttaaattttcgcttcttgaatatagtaccttaaagatgttattagaactgtacttttctaattttagaaccgtatgcaaacttgcactttttcccatcaaaaccaaaaaaaaggtaactctattacatgaaaaaaacgttcaataaagaataggtccaataaaaaagtaacaaaaaatattatatgaaaaaaattttcaataaagagtaggtccaatttgttcagcacaagcacaagttatatccatgtggtgtccagatctttgaggtacagtttctatatatcatatatgcatattctcagttcctaaccaatactgtgtggaaagtatttctctcatacatttggatagcggatgtattaaaactactttggccagtaccacagaatctcctaactctttaaactaaataaaaataaagaaaaaaaatcactacacatttatattttaataaccagtgctttttaggggaatagcaacacaattaatgctttaaccttttcaaactctgtaagatgctttgttttataccattagaataaagcatatgctcaaattgaatttaactgtcctatatatcttatgaagcaaaattagcttttatttatagaaaacatgttgtcctttctgaagtcttgtgacttctaacataagtcttctaacagagtaagttaaattcaggcccagcgctgtggctcacacctgcaattccagcactttgggagaccaaggcaggtagatcacttgaggtcatcaggagtttgagaccagcccagccaacatgacaaaaccctatctctacaaaaaataacaaaaattagccgggcatggtggtgtgcacatgtagtcccagctacttgggaggctgaggcacaagaatcacttgaacctgggaggctgcagtgagctgagatcgtgccactgcactccagcctggctgggcaacagtgtgagactctgtctcaataattaattaattaattaattaatagagtaagttaaatttaatattaatttgccaaattaatacaaatcatttcatataaaaaagttttttttgctgaagtataagttcagattgatttctttccattttcatgggataatacaacagccaggtatgtccctagtgaaataataggtctagacaatggttacaatgatcaccatttcatggaataattttccattttcatgggataattcaacaaccaggtatgtccctagtaaaataatagatctagacaatggttatcagtgactggtaatatcatagagagacataaaacattatgtgcatctagctgatggaagtatacatgccaccacctaaaagttttcttgctaaaaattaaataagtaattaaatctgaacctaactaggcctctagatctaaatgtctcagaggagaaataaaggtgacagaggaatctgttaacaccatgctgctgaaaaaaaggacctgatttcttcagcaaataaactgcaaaggaggaaaaagagggagagggaatctgtagatgaaaagagatttaagagacatggcaatcattgggaggctgaggcgggtggatcatgaggtcaggatttcgagaccagcctgaccaacatggtgaaacctggtctctactaaaaatacaaaaattagccgggtgtggtgacatgcgcctgtactcccagctactcaggaggctgaggcaggagaatcgcttgaacccaggaggcagaggttgcagtgagccaagatcgcgccacctgggcaacagagcgagactccatctcaaaaaaaaaaaaaaaaaaaaaaaaaaaagaggcactgcaatccatagacctcttttaaatcctaaaatccaaactttagaaagcaaaataaaaaactaagtacttatgagacaactgcagaaatttaaataatgactgaatccttatttatttataatgaattaatatttttgatatgataatggtactgtggtttttggtttttaagagtatccctcggttagtgctgggcgcagtggctcactcctgtaatcccagcgctttgggaggccgaggcgggcagatcacctgaggtcaggagttcgagaccagcctgaccaacatggtgaaaccccgtctctattaaaaatacaaaattagccaggcgtggtggcacatgcctgtaatcccagctactcaggaggctgaggcaggagaatcgcttgaacccaggaggcggaggctgcagttagctgagattgcaccattgcactccagcctaggcaacaagagcaaaactccgtcttaaaaaacaaacaaacaaacaaaaactctcttgtagagatacacattgaagtatatgatatatttgggatttatttcaaaaataatctgggattatccaaaaatagtctgggatgggaggaaggggaggatgtgggatatatatagttagtatacaagtagccaagttgataattatgaagccaaaaaatgggtacatgagagtttattacactatgttctctacttttagatgtgcttgaaacttttgttaataaactgttaaaaaacagacgtctaacagatgcttatggtcttaccttatctttagatgaagaatgcttcttggcagctctaggttgatgaatattttctatagtaacattgccactgtatcgatcatgatctgtctcccgtaaacttctatatttattcattcttccccaaagtaaaggttttgaaacctatgtaaatgccacatacagaaaccaaaacctctttagtaaataaattctggatgtcctcatcttaaaatttttgactgacttgaaatacaaaaaattaacaaattatcaaaataaaaagtgtttaagagtttaaattccttgagaataaaaaccatcatactttatgcatacttacacaaacccccaaatcagactcaattatgaatacaaactcaattatatataaaaaataatgactctcagatatctggtaatatactcaacaaatgtttaaataaatgattaaatgttcttcaccaaagcttcatcattagttttcttctccttaccctttcttctattataggaagtgaaatatcaatgaatggatctttcaccgtggagatcttaaaaggaaaacacattgaaaacttcagttagaattctaatataaacatacagttttgtaaagtacaaagaaatcaaacttcccgggcaacctaaaattttacgttaaaaactgttcctgaaaaaaatagcaatttaattgggtattgcagcacattgttaatcaaaacaagatattctcaaacatcagtgaatggtgatccaattgaattttatattactgtcaatatgactggcctgtaatatttaaaataacttaaaaaaactgtttaataaaacagattaactaaagagactagacatttttggttagcttagggctgtaacataagtaaactatgaaatgttaagaaaaagccatgaaaaaaagcagagagcttggctgtgttttatagattctttaagataattttgttttaaaagatactctctatcttgtgagagagaaaacaacttctgtgttgaatagtctagaaacttaaataatcatggtcatgcattctgtgtttcaatgtgacaggctagaatgagatatattttataatcctgcttctttaaggctagagaacacagaaaaatactcataatctgggacaggaaaatgaataaaggctccttttactattaaaatctaacagaaatttaaacctatcatactctaagtcatacacttacagaaatattccttgccaagcaattgaaaatctacaaaaaattcatacatgctttaagttgttaaagatggcattcaaaataaaaattattaagttcaaagtgagtgaagtctacacaaaaatctttaatacgtcatataaactttaaatcaaaggtgatataaccaccctaaattatgttaatacattaagttatttctattggaattagttttttttttttgaaactgagtctcgctctgtcacccaggctatagtgcagtagtgcgatctcggctcactgcaaccctgcctgctgggttcaagtgattctcctgcctcagcctcccgagtcattgggactataggcacccaccaccatgcctggctaattgttttgtatttttttagtagagatggggtttcaccatgttggccaggctagtcttgaattcctgacctcaagtgatccgccggccttggcctcccaaagtactgggattataggcatgagccactgcacccagcctggaattacattttagggcactgcaacgtagcacagttactctcttcacagaagtttttctctcacttcaaacagatagctaatgaatttcagtatattaagataggctaaaactgcctcataggtgtgtcatgaggaaaaataacacaaaaatacatttacttttaaaaatatataaattatcacatttactttctaggagtgtagcgtataaaaagactttcaagaatcattatgtaatcatctgtcaaattttaaaaatgactgccaatgattatatgtgaaagaaaatataataaaaatgatgtgattgtaatccattccatgctgaattgaattctaaagtacctacatttgcacattcttcacacatgaccgtgctagttaattcaccaataaagatccgatctatgaagttcattttcacaccttcttttccatatgctgtaaaaatcatactttttaatgcaaaaaacatgtcaaccatccatctagcagtataataggctatcttctggttattcaaaagtaatctgaataagatattctgtactacatttaataatacattttactatacatacaacattctaaagtctttctcctttacaattttgtagcagatttacgactatcaactactttagtctccaagaaataatgaactattcttaagaggtaaaacaaaacaaccactattcgtaccacacctcaaccactcccattaaaacttataaaacctcatgtctaaccaataagtacccagaagaatggaaaaggagattatgctatcaggactacggatgccaggatcacggctatgaaaataacagtcgtaaaaggcaagtgtaaggaattaacataggtaattaagaactcaagaacatggttatatttttaaaagttaaaattattctgctcaggaaatatttataaattaaaaaaatgccaatgacttagtttaaaataacctgaggttgggagaaaatggattaaacataaaccatgaacgcagtttaagttgggtgacagatataaagggctgcattatgctattctctctactttaataaaaatttgaaactttccatcataaaccatgggaggaaaaagtatattaacaaacctattcacccctctttcaaacttcttttttgagcctctatcttcaagtttcatacaaacaatattcaaaatcatttaaaatattagagcactgaatgacagaaaacatgtgaatatatcagtaaacattaattaaaattgtatttagaaatactataataataaagatatttcttctagaaaaactaaaagggattggaaatagtacaaaactggaaagagggggaagaaaaacggggctgttattctaaacatccacgagatggcactatctcaacacaaaagaacaaggcatatttgagcagctacgttttttaaaaatcttgaacccttaattacaataaagtgcacagtaacaatgtgtgtatgtttgcaaattatagacctgtagtacatacattataaaaccacaaaaacaaaagttagaaaaaaatacaaataatatttttaaatgtcttctaaaaatcacttcatgctaacattagttagtatctcaatgcagaatatacatttagggcaaggtatataaaccctatatagtattgataatgataaataaccaactttgattaggtaatcatcatttggggctcatatttttatggatgaatagcaaacactaggagtaggcaaagtgcacttacacttgacttaccagcactctcttcaataaacggtttatttgcaggagtctttggagcacttaaacattttgtctagttacatctaaaaaatatccataaatccattgatccaaacacatgtcaaatgatacaatatgatacatatgaacttccaagtgtggttgctactttcaacaacctttcaagtttcccttagaagacctcacataaaggtatcggtgtcaatctgtatacttggtatagctttattcttataaattcacatgaatacattctagcattttctatgttccactaaagtatttttcagacactgcagcaactacgtcctccttttaaagccactactttggtggattagttcacataatgttcagttctttttccaactaaaataaaattttaatattttcttaaagaaaaaagttttaacaaagagtcaacatacctttgactttttttctagtttcatcatcagcagttttagtagttgggttgttaaatgcttttagaatgctagcttgtattcgctgtaaaacaaagttaatagattctggtctaataatagttaactcaggcctcatcctcctaataaaagtactttcaaacagcaaggtacactgtggatttcagttccctagtttgaaaataaaatgaccaaattttttaaaaaatgtaatttcttccaggtctcaaattccatgaatagattgctctaatgtcaaattttcccaagtaagagtcagaatttttacatttaggttctctcttggatttaatgtatttttatcagtgtacaaaaagcaagcagcctagtcctgttgcttagcataaattaatttgccctctttcttccttctccctctctctaaaatgacacttcttaattaggaccaaaaaagaaaatagaccatatgaaatttattgtctatgaagacctttctatattaagaagctatcaagctggttactataatctctatgctatgtggactacctcatttatatacacatataactaaagtccaaatttatcaattaatgtccatagcaagaagaatcccccaaattttaattatggttttacttgaacttagttgtcaataatgattatgttttcagcagctctcagtaaatgacaaggtttatattaactatttctacatctcttgtgtatgttttaggaaagatccaatctcacagaaaagtttcagaataaaactacatactccaagaataaaacttagtaagtgaccttttaacattaactatgcccctaattagtggatgaattttgtcttcctaattcagattatgacagtaggatgagggaaaagtttaattatctttccaaaaaatatatatataattaatatatatataatatatatatatatattttttttttttttgagagtcttgttttgttgcccaggctggagtgcagtggtgtaatcactgcccactgcagctttgacttctctgggttcaagtgatcctactgcctcagcctcccaagtacctgggactataggcacacaccatgacacctggctaatttttaaaaatttttttgtagagatggggttttgccatattgcccaggctggccttgagcttctgagctcaagcaagccacctgcctcagcctcccaaagtgctggaattacaggcatgagctgccacacctgttttttgttgtttgtttgttcgttttgtagagacaggctcttcctatgttgcccaggctggtctcaaactcccaaagtgctgggattacaggtggtgcctggtccttcctatcttttaattggaaaagatcactatgatatattaagtgaaaaaagacaaagtacaagttatatatatggtatatgccaccttttgaataaggaaaaaaagagcataaaggaagaaagacaagaacacgggatataaacaatggcaaagtcaaaacacaagagaggcaaagggatctcccaggagcatggttaggaggaattccagagtgacacctatacatcagatatgagaggtaaagaacccagattggagcaatgagacttatgaatcagaaatattgtcaacaccaacatccccttctgccattataacatgcttttaatctaagaacacaatattatatggagaaggaggtgatcacattcttattctcgctccatgccctgctgcctggataagcagaagacactcatgacccccagaattgttctgctgtgtatgatttatgtttcttctgtgtatgatatatgttttttaacacatcctcctccaacaattgtgaaaccgagtttcacttattactaactggcctgtgattaacacattatatttcctataactgttcactgtcctcaagcatattttgaaaattaatacaagattcaaaacacttaaatattttacaaagtaggggataaaagcaaacataaagcaattcataccgtgtgacacaagtcctgaaatacacttatatactataaagaaatcaaacaataaaatgtctcccagaagctattaaatactgaaataatctccaattcagactcaataaatttgaaagttgatataattcagacattgtctaagctaaagttggcttttacaccttgaaaaaagaatttattgaactaaagtaagcaaattggaattgtgtaaattccatgcaggagaaatatttaatgaacttaaatgaaaaattccaataaataccaatgttcactcgcaaatatttcagataatcataacatttcaaacaactcaagagaaatacttctaactcaactcagtctgtaaatttatcctacaatttaaacattttactaattcagacatgatttttgatatgatttaatgaaactttgctatatatcctgaaatgtcatatcactcaaaagaagctaagaagttaccaattcaagcagcaggaaaaaagctaaaaagctgtgattacactctaaaaagagtaaaatgaaattgtttacattattaacttttaaatattagacttttgctttttaattttgatcctaaccgtgaatttatattctctactccaaactgtttaaaagtcaattaataggtaattcatcaagttgaggaaaataaatgagtttacgtccatatacaattcctcattgttaagagttgtgctttgaacaatttaggttaaaagaaagatacatactttggtcagggagctgttaataactgtagcacttaatcaattagcagtatcaaggttcaactatttcagatctccaccttatactttaaaaacaagaatgaaaataatgtacagttttagctgagatattctgtctttaaaataattctaaccaaaaatatattacagtaataaatcttgaagataataaaaatatagtatcattaatttagtgactgtgcaaattaaaaggaaaaaacaaagaagcataaatgtataaattaaaaagactgccttataaaagaactacttctaggaaatttgattttgtacatgaaaaatttacaatttctgcacaaatgatcctttaagtactatattcagcaagagtatattcctcaatgttgtagttcagaaaagactttaatgaaaccatatgaaaggaggtcagtagtttttcatcattactaaaagattctggtggcagacataacactgtagccttccttcaatcaagaaacacatggcagtgacaccctacaacaacagcatgattaacagctgtggagttcccaggccagacaatgcagctcctgccctgatactgtagctgaccgtcaggactgtcctcgcttatgaaattgaatagatccacagacttgacattttaattttactgcaccatttaaagccttcaaatagtgcaagaaagataagagctttcaaaaccaatgtgtcctgctgggctgcctaagatactgtgcatcccaatgcaccattacgactaaacaataatttaattataacaaagactgctatcaaattatagaggtaaaacagaaaaaagtgacagggatatattttactttttttataatatcaacagaaaaaaaaccccaagacataattttaatccattcacatgacttttaacttcacttactaattttttttttttttgagaacgtgtctcactccctcacccagtctagagtgcagtgccgcgatcacagctcactgcaacctccacctcgagttcaagcaactctcctgcctcagtctcctgagtagccaggattacagacacgcatcaccatgcttggctaatttttgtatttttagtagacacggggtttcaccatgttggccaagctggtctcgaactcctgacctcaggcgatctgcccacctcagcctcccaaactgctgggattacaggaatgagccaccatgcccagcccacttacataatttttaattccatttaatgatacatgaccaccacatagtaaacgtattcctgcaaatcatggggaaaaaaataattctagcaattgataaatctgaattaatcttaaagtaactcatatcatctgtaggcccatttattgttcacaatacaaaaagcaacctgttcccaccgtgccaacatgcatctacccctcaacaagaagagcaatataccataattattgaatccaatttaatacttttacaaatagtaaaataattgtggttacattttaaatagcagacttaaaatcattatttctactgactacagatgtccaagcatttaaacttcaatcagcagtattttatagaattagaaagatcattagtttgggagtcagaaagacttgagtttgaagctcaactctaagtatcagttcctagctctaagaaaatgtgatcaaatactagctaggggactacgctaatatcctcaatggttaactaattataaatctctttttttttttcttttttagacacaatgtaggtaaaacaacacagtattatcctgtcggtttattagtttattcaaatacaacatattcaaaataattgcaaatcacaaagaaactagctagtataacatataagaataattattttgatttcttcccaattcaaattctcaaaaaaaagttgcgtttaaggttaagcacatacaactcattcaaaaaacattcacagggagcccggagtggcagctcatgcctgtgatcccagcactttgggaggccgaggcaggcagattacttgaggtccggagttcgaaacaagcctggccaaagtggtaaaaccctgtctctactaaaaatacaaaaaaaaaaaattagccaggcttggtgatatgtgtctgtaatcccagctattcaggaggctgaggcaggagaatcacttgaacccaggaggttggaggttgcagtgagccgagatcacaacactgcactgcagcctaagcaacagagcaagacactgtctaaataaataagcaagcctagtcaacatggtgaaaccccatttctactaaaagtacaaaaattagctgggaatggtggcacaccctgtaatcccagctactcgggaggctgaggcaggagaatcacttgaacctgggaggcagaggctgcagtgagctgagatcatgccactgcactccagcctggatgacagagtgagaccctgtctcaaaaaaaaaacaaaaaaaacaaaacacacacacacacacacacacacaaattcacagaacatctactatgtgcaaggcacacaggacagagacaatacatagtaccattcctcaaagagatcacaatctaagaaagctgacagatagggacataaatctaaatagaaagtggtagggtttatgatcaaatatgtaaaagtagagaggtggcagaaaaggaatgacacctctaaaagctgaattcaattagcttaataagaaagtcaataaacagacaattaaaaataggattgtgatacatgatgttttatagcaggagagagtaattaactcaatccttacttttaaaggaaactttaaagaaaatattagaactctaattttctcttcactggaaactggtcactaggagtaaagagacactgccacactacaattaaaacaggatttttgttgttttttgaggtaggctctgctctgttgcccaggctggagtgcagtggtgcgatcacagctcactgcaacctccgcctctcgggttcaagcaattctcatgcctcagccacccaagaagctgggattacaggtgtgcaccaccacgcctggctaatttttgtgtttttagtagacacatggtttcactatattggccaggctggtctgaaattcctgagctcaagtgatccgcccaccttggcctcccagagtgctgggattacaggcatgagccaccatatctggcagaattttttttaaaaaaggaaggtccatcttgcctagcactacttatcacaagcacatatgcacttcactgaacacttggctgcttttattacatattaccatatagattaagaagtatatttgccttgaatggaaaacaggttttcacctattactccaattatgactgacaagggctgcccacaatggtgtgctcagaaaataattctgaggctgaacccaaactcacctggactgttaggaacgatcagcaatgtcttctatgagtaagagggaggaaaatggagaatgtgtgctgtgtatctgatatccttaatatcttgcattttctctgataaactgatcctatgtgcacaggaaacccctcccagaagaagttgaatttaactaatttaacgttaaagtcaataaagagcctatcagttaggggataggcctacaatcaacactggggaatctatccagtccacaggctattccttttctgagaaatgctctctcatctaagaggctgggactcctctctcctagccacaaacaactgatccatgagtggaatttaatccaacatggaataatgaagtttctgtctactgggaatttaaaaattgagaatcatgaatagccagtatagtttttacatacatggaactatgacatacaaatactgcttggtctgcatggagaaaaatgaagaaaatttacagagccagagaaactaggataataagaagaatgctttctggattcctgacagctttcctgttcctatatccccctatcgcccaggaataatatctccctgcatcttaagattccttttttttttttttttttttacagcgtttcactccgtcacccaggctggagtgcagtggcacgatctcggctcactgcaacctccacccttggggttcaagtattctcctgcctcagcctcccaagtagctaggattacaggcacacgctaccacacctggctaatttttgtatttttagtagagacagggtttcagcatgtttcccaggctgatcttgaactcctgacctcaggtgatccacctgcctcagccttccaaagtgttgggattacaggcatgagccaccatgcctggccccaattcctttttacttaagctagtttaaattattttatttacagccaaaggacattaactaaaaaggacaatagggctgtaaaaggataaaggtaaatatcttacagaagaaagaaaaaatatctagaatatttactctaaaaaattaaattatttctcaactgtacttttaaattgtaatagaaattacttacttagttgtttttttgtttgtttgttttttgagacagagtctcactctgtcacccaggctggagtagtgcagtagcgggatctccgctcactgcaacctctgcttcctgggttcaagcaattctcatgtctcagcctgccaagtagctggaattacaggtatgcaccaccatgcgcggctaatttttattagagacgaggtttcactatgttggctaggctggtctgaaactcctgacctcagatgatccaccccgccttggccccccaataatcccttagttttgtatcctcttcttgaagagaatacatgatatacataaagaaacctgacctttgtttcttctgtcctcactgcatccagaagataatgaagaagctcctgactgtcctgttgctggaaatctttaaatcgaggtgccctgtgatttaaaaacaaaagaggaaagaaaaaaagaataatcattccatggttcatcaacactcttctctaaatgcacttgaaatagcatattattagctgggtgcggcagcctacgcctgtaatcccagcatttgggaggccaaggggcagatcacttgagctcaggagttcgagaccagcctgggcaacaaggcaaaaccccgttctctaccaaaacacacacccacacacacaaaatggcataaagacacagtttactacttttccaactaaatagatgaaatgtgattactggtccaattagggtgtgatcttaagtgtgcactgagaatatggctatcatttattaagcaactactatatgttaagcacaatactagtagtttttcacatgttcaggcataatcctccaacaactttgttgggatgtactgttttctccaacttacacatgaggactcagcagtattgtttaaatcatttgcaaggtcatacagctagcaaataaaccagtattcaaacccaagccactgtgatttattatcttcctaccttaaccaaaaggaaagcaagagagtgtttctatttcatataaaggactataagttgatctccctgtgaatatgttttttaaggacttgataattaaatttcctctgtattaacttaatagaaagatcaggtactattcatggagacactgacataggaaatatttggttgatttcagtaactttaaaaagtaacctacagtaaactctatgctaaaatgaacattttgccttaagtgcagacaagtattaaatctagaaagtgttcagacctaagatgaagaaataattctgtcaaaatacaaaataattagaatatattatagtagaagacacatttacaactatttatgatatttacaacatatctcatgtgatatacaaaacagcactgttcaggaatttataattaatataagttctactttatgcttgagaaaatcgaagaacaagctaagtgccactaacataactacaggtcttttgacagagtgcagtacttaattatttttaattattatctcatttttatttttgtgagatggagtttcactctgtcacctaggctggagtgcagtggcacaatctcagctcactgcaacctccgcctcctgggttcaagcaattctcctgcctcagcctcctgagtggctgggactacagttgctggccacacctgccatcgtgcccggctaatttttgtatttttagtagaggtggggtttctccatgttggtcaggctggtctcgaactcctgacctcaaatgatccacccacctcagcctctcaaagtgctggaattacaggcatgagccatcacgcccggccaagtgcagtactttcagcattattcttcattatctcaggataaatattaatcctaataatacaaagaaagtgagtccctgactgctaaaacattaaccggtcatcaatccagcctgtaagaggaaacaccactccagacattcttgctaactagcagcacatagcaacatgctgacaatactttattaccttgatgggcttccctacctgcacttggtggacagaacccacctcctagattagagatgaggacagaaaccaagatggacacatattctaatcctatttggacctccacagctggcatcaggagaggcagaaactgcagaaccctatacttatgctgtatactccaaggaaggccagtgaagtagcagatgactagaggagggaacaggagaatccctcagagatcttcactagccaagtggtaggtaggaggagggggcagtttatggctttcaaagcagacacacaaggaggaaatcattcctgaacaaagagaaactgcctccaccatgtctctgcctatagctccttctcaaccaatgcaaaaactatttactgccttctaaaccactgaagaaaatttaataaacttagatttgttttttttttttttttttttttttaacctaggaatgggcaaaaaaaaatcataggatgatttctagactctatgatggagcctatctgagctacccatatcaagagagactttcaaacctattaaaggattaaaagataaaaatcaccaaacatatgaaaatattcagcctattcaaaataaggggaaccctaaggattcccaggaaatgtactttagtaaaagtattgccatgagaaagaggagaggacttttaaaaacctcaaggcatgagagaaaaatatatgtacaagcataaattaggagactgtcaagaaaaagaaatttaatccacttctatgttcatcacagtgctattcacaatagcaaagacatggaatcaacctaggtgcccatatatggtggattggataaagaaaatgtggtccatatacaccatggaatactacacagccataaaaaagaacaaaatcatatcctttgcagcaagcaacatggaagcagctgaaagccatcaccctaagtgaactaatgcagaagcagaaaaccaaataaaacaaacaaaaaccacaaagttgaagaccttgctcccaaataaggctcatcacaagtggtcaaagtgtgtgataatcaccactataacagaaacttcaagagactggttcatgtacacacaatatgaataaaccacaaattatgccaagtgaaggaagtcagataaaaaaagagtacaccctgtatgattccatttctatagaattccccaaaatgcaaactaatctattgcaacaacaaaaaaaaaaacaggtaaggggtataccacccagggatggagtttaggggagaggttctagagaaagggattataaaggggcccaacaaaactttggggggtgatggatacattcattacattgaatgaatgtatgtatatatacatatatacacacacacacacacacacacatacacaaagtgtatagatatgtcaaaacttatccaatagtatattttattttttagagagacaggggtgacaggagtgcaatgacattaacagctcactgaacactcaaaactcctaggctcaagtgatcctcctacctcagcctctagagtagctgggactacaggtgtgcaccatcacacctctggctaatttttttttcatagagtctccctatgttgtcctggctagtctcaaactcctggcctcaggcagttctcccaccttggctcccaaactgctgggattacaggcatgagccactgtgtctggccccagtagtacactttaaatatgtacaatttattttatgtcacatataccttactaaagctagccagaatatccaccaatacaatttactattccaacagacaaaaaaaaaaaaaaaaaagattatttggatacagaaaaagcatttttaaaaaatccatttcttaataagaactctcagaaaaaagaaaaactaagaataattgggaatttcctcaacctgataaaaggcatgtatgaaaactctatagttattatcacacttacgtgtgaaagactgcatgctctccctttaatatcaggaataaggcaagatgcctatttcaccattctaacattgtattggtggtcctttttcattttttttccaagaagagtcctattgcaatatgtattggttgtccctgacagtgatataaaatgagaaaaagatataaaatgatacagattggaaagaaagaaaacaatcttcatttgccaatgacattgtctacataggaaataccaacgaatcaacataaagctaagagaactagtaaagcaagttgggtagggtagcaagaaacaaggtcaacatacaaaaatcaactgtatttctgtatattaacaatgaacaattggaaattgaattctttaaaaagagtaccatttacaataaatagcataaaaacatgaaattcttaagataaatctaacaaaatatgtgcgggatttgtatgctgaaaactatacacccttgatgagaaaaatcaaagacctagaaaactggtaagatatcatacatgaaaagattcaacattgttaagatgttgattctccccaaattgatctacacattcaaaacaatcccaactgacaatctgattctataatttacataaaaaagcaaaggaccggccaggcgcagtggctcacgcctgtaaccctggcactttgggaggccaaggtgggcagatcacctgaggttgggagttcaagaccagcctgaccaacatggagaaaccccatctctagtaaaaatacaaaattagccgggtgtggtagcgggcgcctgtaatcccaggctgaggcaggagaattgcttgaacccaggaggtggaggctgtggtaagccaaaatcataccattgcactccagcctgggcaacaagagcgaaactccgtctcaaaaaaaaaaaagaggacctagaatagtttgaaaaggatgaccaaaatttgagaacttatgctactcaattgcaagacttactatgaagctacagtaatcaagacagtgtaggctttggggtaaagacaagacatgtagatcaatgaaacagaatatagttcagaaataaacccaaacacatgtggcttaaatctttacttgattttaaaaaaatatatttgtctaatgtatacttcttttaaaagtaaacgccataaaacaaacaaaaaaaaggcaatttaaaacttttcagccaagcatggatgacgctcatgcctgtaatcccagctacttgggaggttgagcagggaggcatgcttgagcccaggaattcgactatgattgggccactgcacttgagcctgggcacagagcgagaccctgtctcctaaaaaatacaaaaaatacataaaaatcttcaaataatgtttgatctagttattctaagaatttatcctacagatgtacttccgcaagtacagtgtattcatacaaaactgagtaagttatacacacatgtgctaacatggaaagatgtataaaatatatcaagcaagttgcaaaaaatttgcatatgtctgtgtatgtatgatcacttttggaaagaatcagataatagttacttctgaggagtaaagatagagaggagtttgaatttttatctatgagtgcccattattttaatagtaatttttaaaatgttaataaacctttataaccaggaagaaaactatacaaaacaagttatttctggcaaagtcagaaacaaatttctaaagcatacaatgacctagtaactttttttgttttaatttcaacttttattttagattcaaggggtacatgtgcaggtttgttatctgggtatattgtgtgatgcaaaggtccggagtacgaatgatcccgtcactcaggtactaagcatagtaccgaatagttagtttttcaacccttcctccctcaatctctcccacctctagtaatccccactctctactgttgccatctttatgtccatgagtacccaatgtttagcttccacttatgagaacatgtggtatctggttttctgttcctgcattaattcacttagaataatggcctccagctgcatccatgttgtcgcaaagaatatgatttcattctttattatggctgtgctaaaaactttttaactctgtgagacactcatgcctctgagaattttgcaggtttttttggtcctcaggctttgaagaaacatcatttgccaaccaaatgaaacatacactaagccctctattttggactatatttaaaatatcatggcattcattactagttttaattaaaatgagattttaaagtctatagatatacaaaaacacaagctcatattcaaataattttccttctacatattttagtaattgtggactggactagcttgtgagttccatgaggacagggtgcatttgtgacgcaatatatgttgtgtacccctgaattgtagcaagtacctcataaaaagcaagctctcaattttttatataaatgaatacatgaatgcattaaagtcaagtcagatcctttatgtgtttatttccaggcacataaggatttggtttttaaacatactgtaataccttgagaaattcacttaaactctatttgcctcacagctcatcttttaaaataagaaagctagattagatgttatcttacggtactttctagattttacaactctatggttttctcactttatggtattacaacataggcatccaagtcaggacagatctccatttgattctcagcttttcactcagactaggtgagccatttaatttctgtgtctccatttccttatatatgaggataagctgcttcttctgaggactgagatataattttcataaagcatagagctgtaacaaattttagttctcttcatagtcagggcaataagagcaaagttacagtaaaaacgactattcatgttaaatgatgaatacattagtattttgtaactcataattatttatattaaatgtagatgcacccacttctgacaaagctgattaaaaagaactttaggagaaagtggtcctttttcagtctccttcatgctgtgaagaaacaggaacaaggctgaggtcagtggtccaggccttgaaagttccaccaccaatgggtcctttaaaaacatgatcaactctatgtcagaaatgtacaatttaaaaataacatattaaaaatctgtgagttacactctgcttaaataacaccaactaaattgcctcaattgtattaagaaactttattatttcataaataaaatatataaaaatggaaaacagaatacctgccttgaaaaacacaggtattttcatatcctctgccctttgcttaataaaactattagatcaaatgatatcaccaatctttagttgcttgtcactgtcctttaatgcactctcctataaataaaatcactaatctacttaatgtttgtaccactccacgaataatcatacattatttgctagtaaataatgtatgattatttgtgtataatgtaggattatacacctttcttttccccaaatattttactagtaaagtaataatgtggaatcatgtaacaaaatcagcataacatctccctcttttaaaggggagagacataaagcttgacaaaagcagctaacattgggtgaaggattaacccatttaattctagaatttttttcccctcgaaatctggtttctaaagtactatccccaccaataacactttctcctaaaggacaaggaatagaaagcagatcccaaatataaacttgggacattaaagaatgttatcttccggccgggcgcggtggctcacgcctgtaatcccagcactttgggaggccgaggcgggtggatcatgaggtcaggagatcgagaccatcctggctaacaaggtgaaaccctgtctctactaaaaatacaaaaaattagccaggcgcggtggcgggcgcctgtagtcccagctactcgggaggctgaggcaggagaatggcgtgaacccgggaagtggagcttgcagtgagccgagattgcgccactgcagtccgcagtccggcctgggcgacagagcgagactccgtctcaaaaaaaaaaaaaaaaaaagaatgttatcttccaagataactattgaatatattgtcctattcctatattcatgaaataactgttacatatgtattttataacaactatccttaaaaatccactataatcacagaaaggacaggctataattttccatagtttttttttttttttttttttaaagagacagggttgcccaggctggtcttgaactcctaaggctcaagcaatcctcccgcctcagcctcccaagtagctgggatcgcaggcatgagccaccacacccagtcaaaattacagaggactcaagacagacttttgtgttttttctttttttttttttagacgaagtctcactctgtcacccaggctggagtgcagtggtgcggtcagctcactgtaacttcaaactcttggacccaagtgatcctcctgcttccacctcctgagcagctgggactacagatgaatgccagcatatccagttgatttttaaaatttttgtagagacgggggtagagggggggtctcactttgttgcccaggctggtcttaaactcctggcttcaagtgatcctcccactccggcctcccaaagtgctaggggattacaggaatgagccatggtgctcggccttccatagcttttgaatgtcaaaagtgcttttctgggctggatgccatgactcacatctgtaacctccacactttgggaggccaaggtggaaggatcacttgagcccagagtggaaggcccgcttgggcaacatagggagactccgtctctgcaaaaaaaatttaaaaattagccaagtgtagtggcacgtgcctgcagtccgagctactcaggaggctgaagtgggaggatcccttaagcccaggctgcaatgagccatgatggcaccactgcaccccagtgtgagtgacagaatgagactgtctccaaaaaaaaaaaaaaaagtgttttctcttctgctgtaaacttaaaactgctctaaaaaataaagtctatttttttttaaagtgttttctgccatgttaactgaaagttacctcaagggtcaaaagtaaaatctaaggtaattttaaacttcaagtaccaagttgcacttcccttttctcaatgaaaatattttttagacagaataaaaaaccttcagaatgagatgaggaaataaccttagttttaaaaagtacatttagacctggcgcagtggctcacgcctgtaatcctagcattttgggaggccgaggcaggtggatcacttgaggtcaggagtttgagaccagcctggctaacatggcaaaaccctgtctccactaaaaatacaaaaaaaaaaaaaaaaaaaattagctgggtgtggtggcacgcatctacagtcccagctattcaggaagctgaggcaagagaactgcttgaacctacgaggcagaggttgcagtgagccgagatcgtgccactgcattccagactgggtgacagagcaagactccatctcaaaaaataaataaaataaaaataaaaaatacacttaaactttgaaaacaaaagtttgctgaaaacgcaagaaggatgaatttcacacataatgttgacagaaagaagccaaatgcaaaataatgtatatagtaagattccatttatatgcagtattaaaacaggcaaaactaatctatcctgttagaaaccaggttagtggttactcatgtgggttagggaagtagtgaatgtgggggggagttgaaggggccttccagatgctggtaatgttacttgagcaaggtgttagttacacaagtgtgttagctgtgaaaattcatcaagttatacactcataatatacattttaaagaatattttcattaaataaaaagttttccacacacactgttgatatgcgcataaatattaaattgaatccagcagcatataagcatatcataactggggtttgtaacaagaatacaggataggtttaacacttgaaaaaggaatcagtgtaattcaccacattaacagaataaagaagaaaaaccatatgatcatctcaatagatgtgggaaaagcatttgacaaaattcaacatccattccgataaaactttcagaaaactagcaatagaaaggaatgtcctcaagcttacaaagaacacctctgaaaatcgtaccttcgtatgtaataatgggagaaggctgaatgtttgttcccctaattttgggattaaggcaaggctgactgctcccatcatctctattcaacatgttactggagctctgagccagcacaataaggtaaaaaaataaaaataaaaaaataaacggtatatagacaaaagacaaagataaactggtgattcaaagggcagtaaccaactcaaagaacagtgccacagctcaggtcaactttatgccctaaaaacctaagatataagattcaaaattaccctgttagaatgatacaaacctaaagttattaactacagtatctaattgccatatagtaatcctgaaacacagctctgcatgtcaaatatttaaactcaacatccaatcgcatttaacaggaaatcacatttaacaggtctttttaaatgactaggcaataacttccctttagtagttttaaggatctcactacactttatttagaatagggcattggaatctatcattaaatttttaaggggctgaacaaatgtttacaggctgcttttcgactatatatacatatatatatggtaaacatttacatgtaaatatatatataaaaaggaggttattatatatatataacagtatgttatatatataataatactgtctttcaaagatatatatataaaacaatactgtctttcaaaagtgcctactgggaaaaacaatctaagattactaagcatgtttagagggctaagcatttttagaactctttaattgttttcaaaagtcagatcatgagctatacatatactctgacttacacacttacacacacacacaaacacacacacacaggctgatcaatttctcactaaaattatccttactagtatcaacacctcccagccaaagtccatcagaaacacacctatcgttgaactaggtgggtttattacttgtggcagtgagggagatcacgcagcatggggaaccacagggtgtcctagtaagagagtgctgtaaagaacctacccaggatttaggctctggttgaataacctgaaggtgggtttcaggaagcagaggtttactctagagtgaatgccctcagaaagcgaggctaattctatcatgggacatctcaataaatcttacatattgtggcagttggtgggggagactaaaatgaggataaatctctaactagtaaagtagcattccttcatttctcattttggctgaaggagggtgtttcagattttctaaatggcaaagtgatcttgttttagacaaaatcatgaagtggacttgctttgtcttatttcatcgtagtctcagagaaacctactatcagattgttattctgtgggattatctgaataacatggcctaactgttggtgccaggccagcttctgaatatcaggggctgctctttttttcatctttctcactagcttaaaaatctatcatcaggctaggcttcaaaaaacctttagatgtggccgggcgtggtggctcacgcctgtaatcccagcactttgggaggccgaggcgggtggatcacgaggtcaggagatcaagaccatcctggctaacatggtgaaaccccgtctctactaaaaatacaaaaaaaaaaaaaaaaaaaaaaagttagccgggcgcctatagtcccagctactcaggaggctgaggtaggagaatggcataaacccgggaggcggagcttgcagtgagctgagatcgcgccactgcactccagcctgcactccagcgacagagcgagaccccgtctcaaaaaaaaaacctttagatgctcactattaaaatttcatctttctttaaagaacaaaaatgctaaatttaaacaaatgtcaccagaaactacaaaataggggttataggcattttgctcaatagaagtcacacctcttttgtttcttccagtatgtttattttaaagctgccttgatatctttttattatttgatccatggcatattggaaccataacataccttaaagttatgattttagaaattttaaatctgattattttcacagaatgcttttaaattatttttaagccccctggctactatcttagttgactgatctgcgaattaggaaaagagattttggtaacatcagtggctcatctgaaagcagctattattcaaacagttattactcaccagctgagagtctgaggaaggaaaaatcttgagttttgtactactttctttgatctcattcatcagatcagtaagagtataagtctgtgccaagttctaaaagaaaacaaaattaaagtcttcagattcagttaaaatatgcctctgattttatggaatacactctcaaatttcatctagcatagcaaaagtgtctatttcaaaaaatattaagatttagttgagtacattttacatttagtaaaggtcactattaccgatagagccatggtaaaatacacagaagacctttcagaagccctgtgtgaaaataaggtacatgtatacatatggtgatggcccaagatagcgtaaacaaaaggaaaacagagaaatttctagaggaacatttagcagtcatttgacagtctacaggtgagccaatgactacataaattaagagaatcttttacatattacaaagctttctgatgactcttacctgcatgactgcattaaaaaagcaagtatttcctaaatttgtaattcctcttacagataaatttctgcattttcctcccttctgtatttcatctgtttcacatttttcttcacaaagtttcatgattctagaaaatgcacctacaagttagagaaaaaataactgacacaagatgtaaagataaatatgtcacttaacataatttatatacattatttaaaattaaatttaaataagattatctccctgaatcagtgttcctgaaggggaagaatataaacacaactatctttggttttatattttattgctagaggaattaatttaaactttagtatacagatctgcacctcacactatattacagaataaattgcagatgaattaaaaaactaaatgtaaaagaacagtcgagaacaagtagaaaaggtctaacttctaaataccattacccatgaaaagaaataaggacgtctaggggaaaaggctgattcttaacccagggtagcaaagatgcaaaatgaacccataacattttgccatgccagagagtaaggaagtgctcaaaatgtgtgattgggaataagtcaaaatacacagggattttgaccagctcgttcaattcagataatttgatcataaaaataagtaagggtagtataatagattattattcacagaatgaatctgaattggtaacagattttttaaatgagaaaaagtagggaagagacttccttataagagaatgccagctaatagaagaaatgacagaattaggaaaatcaccatcctatagtggcaatttttgtattattcttgcaacatttctgtgaatttgaaaatgttcatattaaaagttttttaaaaataaacagaaccacactgtaatacaaaaagtaaaatacctaagtatatgacacataagtgcatgttttgtgcttacagatttgtataattaatgcagatttgaaaattatattaggctggccacggtgcctcaggcctgtaatcctagcactttgggaggctgaagcaggtggatcacttgaggtcaggagttcaagaccagcctggccaagatggtgaaagcccgtctctactaaaaatacaaaaattagctgggcgtggtggtgcgtgcaagcctgtagtcccaactactcaggaggttgaggcatgagaatcacttgaacctgagaggcagaggttgcagtgagctgagatcatgccactgcactccagtctgggtgacagagtgagactctgtctcaaaagaaaaaaagaaaattatattatcagttcatgtttactaatatgaaaacaaagaacaattcctaacatttactgacatggttgactacatgtatttagcagattactctctgaatcaaaattatgataatttgaagtttgataagaaattcccaagttctgaaatgctttagttttaactagatgttcttttaaattcctttcagccctcagattttttcttttttaaaaaacagtgtctcactttgtagcccaggctgaagtgcagtggtgcaatctcagctcactgcaacctccgcctcccaggttcaagtgattctcgtgtctcagcctcctaagaagctgagattacaggcacctactaccacacccagctaatttttgtattttttttcttttttttttttagtagagaagaggtttcaccatgttggccaggctggtctcaaactcctgacctcaagtgatccacccacctcgggctcccaaagtgctggaattacaggtgtgagccaccgtagccagccagcccttagattttatagttctttacaattacatgtttttttcacctaatactgacatgctgccttgcattactaattaacttataaatatttggctgattgatggaaataggggaacatctcttactcttgctcttcctgccaaaggggtacagcactggggggactgttcataataaaaattcgaaacacataaaaatctgcaagattaaacagcagaactagtgggttagcttcttacgtctctgacaagttcttaagaggaaataaattatgacacctgccccacttctgtaaacaacattaaaggagatgaacccgagtgggagtggccctgttctaaggagcaggaagtgctgggattacaggtgtgagccaccgcgcccagcagaagatgtttctttcattaagcaaacctatttcatggaaaaaagttttctttaagttctaacaacttttatcctgtgctacaatagtttttataaacgctattaactggtttccccctattcctgttttttttattctttaaatgttattggttgttattggaatgtgttcagatattaaggagctatttttaactcccaactccagaatcctgaggtaaagcagaaaagaactagcaagataggtctcttttcctgtcctccaaatattataataaataataaaccccacactagagcttgggggcaaaggccagcacaatcaatgaagtgggtcactgaagtacaaacaccaggcatggaaaaaagaaaagggggaagaggccaggtagttttcaaatgaatataaaagcaaatgaaaaaagccagtcagtacttaagaagcactacacaaacaagaggaaccctgatatggatgctggctgggtttacagacagaacagtctgcttcttgtttatatctgagactgtaaatagaacctagaataggatgggttcagactctcattattgctgttgccaaaaggtggtttcatagtgatttttgagagatttaagatgagagagaaattaaatccaagcattactcaattttttcaggctgttaactctgattttacatttataaaactcagtctccaacaggttaagtgatatgcccaaggtcacaatgataatcttctgattataaattcattgtcattttaccacctaaattctcttcagtgatttatgtacaatgagaagaattataaaagacagtaggtcaagattcttacagatttgggtatatgcaaccctaaacaaatatgactcctcaaaaatatctttttttttttggcttcttccaaaacatgaagcagacttaacattcttaataaatgttgccacaatattttttagcttattaacatgaaaacagaatggctggaagaaataacctatagataataactatatatgttttatatacttatgaaatatatatacacgacgcctattgggcctgttttaaaaaacattaaaaaatacatatatacacagacacattattcacttgggaaaatactcctagaaataaattatattttaatcttgcaaagacacataacattttaaaaaccataatatgcaaatgtatctgtgtgccacatttatccaacagttttcaaaacatctgggatggcatcccaaagtaaacaatgttcataagaccatctggacaaaactgcaggcaaaataaagcataaacatatggaaaaacagattttccccctcccttcagcagtaagggacgacaaatgtcaaaccaagatatatccacgcttcactgtgtgatgcttttcagcaccacctggctctccatgcatagccaccaaatatggacagcactgccagaaagaacatacccacagggcagtggcaataaaaagagtttatttcatggttaaatagccacttcacacaagtggccaagggtctgtttgttgacttttacatgtaagtctgtgagaaaatattaaaaattaactacgctatcaaacagataatttaactagaaaatagaatttttttttttttttgagatagagtcttgctctgtctcccaggctggagtgcagtggtgtgatctcagctccactgcaacctccgcctcccaggtacaagtgattctcgtgcctcagtctcctaagtagttgggattacaggcatgcgccaccatgcctaactttttgtatttttagtagagatggggtttcatcaagttggccaggctggtctcaaactcctgacctcaagtgatctgcacgccttggcctcccaaagcactgggattataggagtgaggccccgcacttggccagaataacatttctaagagctatttaagtgttttacttaaaataaaagtgtaagtcttaaattttactaaggagtacatttacaaaatgtaacaatttaaattgatttatcaatgccctttgtgtatcaggcactatatgaaccactataactgtttacacctaatttcttatttatgactggagtataaagaattgatacatagtaaactagtaaacagcagagaccttaggccttaattttttttttttctttgagacggagtctcattctgttgcccaggctggagtgcagtggcacgatcttggcactgcaacctccgctccctgggttcaagcaattcttctgtctcagcctcccgagtaactgggattacaggcacatgccaccacacctggctaattttatatttttagtagagatggggtttcaccacgttggccaggctggtcttgaactcctgacttcaggtgatccaccctccttggcctcccaaagtgctgggattacaaacatgagccaccacactcggccaagccttaaatttatgataactgtaatatctcaggaaaacgtttagacactaaatatacttgttgtgcatgtgtttactaagaagctgtcaactgagagtttacaattctagtttaaaacagggatgtctgaatcagtctcaattacttgacattcatgcaggtatgtatgtatgtatgtatgtattttgagacggagttttgctcttgtcgcccaggctggagtgcaatggcacaatctcggctcactgcaacctccacctcctgggttcaaatgattctcctgtctcagcctcctgaggagctgggattacaggcgtccaccactatgtccagctaatttttggtgtttttagtagagatggggtttcaccatgttgtccaggctggtctcgaactcctgacctcaggtgatccacctgcctggacctcccaaagtgctgggattacaggcacgagccactgcgcctggcctgtatgttttaataaaaagcagcttatagcttctactgaagaactattttgatcattttgttttcagagataacaaagcatttttcaatctggcagtgcaaacattttagatgatattaaaaattctcttcttcctttataaacacagaaccaaatacaataaggaatgaacttcaagatgtttttaagtatgatataagtaagaggacaaagttgctacaacaataaagacaaactatacaaaatttttattatcatttcttttgttctcctaaagttttacccacacctacaaaaaaagtggtctgcatagtcaaaaaggtaatcacaaagtttccaggctaggttattttattaaaagggatttatctcaccttgggaaataaatcaaaactaataaaaaataaaagcaatttaatttactctacttatcacttctatattactaacactgtcatcctttacataaaaagataatatagacctggaatgcaaagaacattgagagcacactttcggcactttaaagtttttaaagctcttgtacatctctgtagtttacctttaagcctataatctgagtcctcaaaaagtagctgattgaggactgataggttttgcatgtacctcaagtcttcaaagacaaaactggctgaaataccagcaaagcaaaaacaaaacaacataaacaacaaaacaacttgtctaagaactttaaaaaaaaaacttaagatattacctcaaatttttccagcataaaaattacttcaacacttagagatcctataactatctttttaaaaactgagttcaaggctgggtgtgatggctcatgcctgtaatcccagcactttgggagccaaggtggcaggatcacttaaagtcaggagttcgagaccagcctggccaacatggtgaaacctcgtctctactaaaaatacaaaaattagctgggcatggtggcgcttgcctgtagtccaagctactcaggaggctgaggcaggagaatcgtttgaacccgggaggcagaggttgcagtgagctgagatcatgccactgcactccagactaggtgacagagtgagactgtttcaaaaaacaaacaaaaaaactgagttcaaggatattaaatcataaacataaaaaaactcaaaagtaccagcaaattttaggtgaatatctttagaatcttggagagcaaagactttcaaagcatgaccccaaaggctaaaaacagaaaagactaatgacctggcaacaatgacattaaaagcttcattatggcaaaactgaactataaacaaagttaaatatggaattatgggcactattgtcaactataccctttgtacaagctttcttgagggcagttttacaacagtaatcaaaatttatactttggccaagaaattccaaaaaaatttcacctacaaaataaaagagcaagtatacaaagatacagctttgtttatcacaggagaaaattgaaaacaaccaatagtgggtttgttgtgaagtaatactaaattggtgtctttcttttcccaaaggtgtatttgtgaattgccttggttaaaccaaaagtggggaacactggttcttccctttcttcccataggcaagggagaagtgaacttattttgcatttagagtcggatagtttgagagtgtatctcccttaaattgtcacctctgataactgtccccattttagaactgaagcatttcaaagatgaaactgaggtatactgctggttagtgttgagggaagattcaaacccgggcagtctagcttcagaattcacacacttaaacattatctactgtctgttataataaagatgatgcaatttataagtgtgatagtagtttaagacactaacaaaatgccagtggtgatatgaatagcaaagccattactcttaagtaaaagctgtatgtaatccattgctgcacatgttttgtgtttggatttatagcttttttagtcatagtttgtagcagtccttctcaaatgattccttaaaaaattaacaccctaacatcctaggtacccactgcatgcaattaacatctccctatgtatctggaaggatactagttatgtgacatctttgggaaaactgagaaaatagtcactctaataattttactgtgttttgtagtatcgatgaggaaccccaaattaaaaaccctatatgtaaaaataggttgtttttaaaatgtcattatctttttgaacctagccccttgtatacactgaaacaacgatttttagtgcttatttttgaaaatgcaaatttcttagaaacatgactgtcactttagagaactgtattacctcttaaaaaaacagacaaaaataaatagagatagggtcatgttatgttgtctatgctcgtcctgaagaactggtctcaagcaatcttcccaccttagcctcccaaagtgctgggattacaggcatgagccatacatgtgcccagcatgtatcacctttttttttaaagtattaaatagtaatcaaattgttactgaaacaggtcataatattatactcagatggagtttcagatcccaaacataccaccacttactttcttatttaaaaaaaaaaagatacagcaaactcatacttcataaaacccacataattcatgtctattgtaaaccaggagcatgagcttaataaattcagcaggatatagtattttgtcttctctttaaccttgttaaaaatggcatcccatcaatattaaaattatgagccaaatgcattggtttagaaaagaacatgggattgtcagtcatctatttcacaaaaaataaaccaatattcaactacatgattttaccaggaattcctagattctctaaatatttgtagaacacttcatgacatttaaaagactattaaagtgagaaatctctgagactttcagaggacaatggcccactttaaaaaaaaaaattttttttcaagcaggttttaggttcacagcaaaactgagcatacgttaatggggattttccatatcccccctaccccaacacatgcatagcctccattatcaacatcccccaccagaatgcttcatttattgtaactgatgaacctgcactgacacatcattatcacctaaagttcctagtttacatcagggttcactcttggcagtgtacattctatggatttggacagatgcagaatgacatggatccagcattatagtatcatacagagtagttttattgccctaaaaaattctctgtgctttgcctattcaccccttcttcccctcaacccctttcaaccactgattttttttttactgtctccagttttctggtctactttttaacaatacctatttctgggtgggactcacaaaaatgcttatttgcccattttcagtcttgcattatatatgacctttttattccatgtatggggaagggggaggtagagggagttttgtttctataagcaaatcctaacatcagatgtgaaatctacacagctgtaagcattcttctgggaacctgagctggggttcatctcaactgcttaatgcaattacctaaaccagtcatgtagtattaatgtaatctgcccatttctacagctgaaaagaagtttaatatttaaagagtgagtaaaaagagacaacttggtgccccacaattcccctagcttggaaccaaataataattagcttgccagtttactctcaaaatcgactaacttccagttaaccattatgccttagaaatctttacttagtcatatgataaattgatattaacataataaatgggcagttatacatatataggcattcctatctgtctccatacaagtcaaactgagatctacaaaatcactgatcagccacttctctgcttaaaacttaacagtggttcctcactgccctcagaacaaattctatctgtacaaggcccttaaatatctgttcttacttacctcaagtctcacctctcaccatcttctacaccacaaaactcaacttttcagctgtctagacttgcctgaacctatcgagctctcgtcaatgagctattttctttgcctggaacacacaatctgttccctttttgcccagataatttctagatattcttctgcttccaactaagtcggattattcttctaaatagaattggcctgactcctccagtcgaatgttaggtactattccaaattgttctcacggtccctcgtacttgctccatcacagcactatttaaacaggcaagtataactaagtgcaatttgtctatatccctcaatagaccaaaagatcagtaatgacaggaactagaagtagatctgtctcattcactactgcatctccaacatctaatgcagcatctggtacaaagcagaaactcagagatattaaaagactgaataaataattttgatattaatatttaggattttggagggtgaaagtgcaaagcttatctatctacttcctcaacaaaaactggtcacattctatttggtttattcagcaagtatttactgtctacccacataaaaatcaaaaagaatataatccagagtccagtcttaaggaacctacagtcttgagagaaaataagacatgtacaaacataaatatgaaacatcaaaaaagtgtgttattagattctaaagtgtgctgcacagacactgagtgccaaaaaagagataaggattgggaaagcatcctagaagtaggatttgagctgagccttaatggataagtaaggctgaagacagaaaatataaagacaaatgtgctacagttcagcacttctcaaagtgggtcagaagacaacttccttctttcaagggtacttaaggtcaaaagtattttcataataagcctaagattttatttgctttttttactttcattcactctcaattatacaatgccgttctccagaggccatatggcatgtgatatcacaaaggattaaatgcagaagcagatatgagaatccagctgttttctactaagccagacacttaagagtcttataaaaatgcaagacagtgccactcattatatttttgttttgaaagttatcttttctacaaatgttatttgtgttaacatggcatagtatttatttcatttttatttttagagccaagtctcgttgtgttgcccaggatggtctcaaactcctggactcaagtgatctgcctgcctcagcctcccaaagtgctctgattacaggagtgagccacccatatactatatgattttaggatagtgatgcctaaaagtaaaggaataaagaaacaaaagaattaatgacatgctttaaagagaaagaaaatttctggtcatgcataacttcaaaatgtgtttaacatacaggcacaggctttcttctcaataactatttttacttagtacaaaaatataaaaataaccttttaaaatcatacttatcctctcacccaaacacaataatacagtttcatattccttttatcataaataggtgttttcacaatgtttcacgattaccatttagtgcaaaatcatatccggcattcttacaaacctcaataaaaactttcatatttgattttccaaatattttataaaaatatacggaagccgcatacaaggcacaatatggcaaactattatatccaaaaacttattctagaatgccaaggaatattattttaaatcaaacttgcctgagagatcctgtagcttgacccacagggataatgacatcttgccctagaactgccaaaagccttaaactaacaactatgtatctctcaaactttgaaagctccactccctctcaaactacctcaaaagcccgtgccccaccactccaggtgctattcacggttccataaacacaattaaggcttatattagtgcttcccaccacctgaaatgatttcttctctcatcttcacctgcccaaagttcatcctttaagggtcagcttgaaagccggctcatccatgattcctttttagttcctacaactgaacattatatccctctttggatatttgaaggactttggttgttacctaaaacagaaatcttactctacttgcatatcattactgtttaatcttacaccttctttcagatctttagcctcttaaagatttagtgactgtcttatcaatctctattccctgaagcaccttggaaatataaagtactaaggaaaaatgaggcttgcataaacagattactgcctggggtcacacacctagtgacagagtcaaatctgaacaccagaccccctgactcaaagccatctactgtctttttttcttttttttgagacagtctcactctgtcgcccaggctggcatgcagtggtgtgatctcggcttactgcagcctccgcctcccgggttcaaacaattctcatgcctcagcctcctgagtagctggcgttacaggaatgtgccactatgctcagctaatttttgtatttttagtagagttggggtttcaccatgttggccaggctggtctcgattcctggcctcaagtgatctgcccgacttgggctcccaaagtgctgggtttaaggcctgagccaccgtgcccaacctcaaagccatgtactttccatcataccgtccatgctcccttcctagcatctttcttataatacttattcaagaaatcagtaaaattgaatgaaaatcagactggctttgtacttaaccttagggaatctctaaggtaaaaaaaaaatccagagaaaataatttctaaacttgtactttcatcacccatgccatcatatccctgcctatcttcttattatggccaatgaaacttaatgctcatttttcagcagacagaattatgaccaacttcagttccagtagtgttacaagtctttcaccaccatattttcctggttctttatttgagcagaattggagctacgactagtatgcctgctgcagaacagaattcaataaatgtttgttgaataagtaaatgataagtgatcaaatgaatcacttctactgctgtccaggagcctgagtttaccttctctggttcctcctccagttccttcaccattactgtctcattagggtgatggctaacaaaaacagctgtacactgggctatagaaaacacagttggcaactatatttttatatagcttttcagtttctgatgccacctactaagcaattcaattctgcttcaaaggcaactcaaaattatcacgtccattcacctagctgttcagtaaaaatcctgaggtttgtattaatacttaattcctcccactctccctccctcactacatgtaatccactcactccccatgagtatctatcagcctctcacctgcccccccacaatcacctccttaaccctcttcatgatctccccacccccatgcttaactccctacaatctgtgtgccacatagcaatcacttatctttatttttttaaaaaaatatgaaattaccgtgatacccccctgcttaaaatactttagtaatttctattacacttccaaaaaaataaaaattccttaccatggagttcattacagtatctgtcatgaccagctcatctacctcgtaacttcatctctttgcactctctcctaacaaaccacgtttctgcaatattagcctttcttgatcactgtgactactatattattagccagcacggcaatctgttcctttcttttgtagcacttaccagaagtcattatatatttgcattttttgcttgttgctcccactataatctaacgcctagagggcaagataaaactatttttgttttactctaatactacagaccaaataaaatttaatacctggcatgtgggaagcacttactatttttggaggaagaaactattatcctatacactcttaacatacgttatgtattatttatttgttaggtaacaaagtatacaataacaaaatacataatacattactgttatataataaaggatctggctggcttttctccccaggttcctgggaagtaccctctaaatcctcggaatttccagagcgacaagagtgtctgttattcatgatgggtccctcaggccacatttgacagtttatatcaacaaactgactcactgtgggcccctagacagtttatgctgaagagatgaatcaggatggggcctggccctgccagaaagaccaaccatgtgattagaatgttgggggcctagagactgagttaaatcaatatggccaatgattcaatcaatcatgcctacacaatgaaatcccaataaaactctccacaccaaaactccagtgagcttccttggttaccaatactcttgtgtatattagtgcacacgaatgcatgggctggggagagtgaggagaatgcatcctcattccctctggagtggacacagaagcttcacatttgggaccctccccagactttgccctatgcatctcttcctttggctgttttgtatccttttttgctatattaaaactataattgttagtacagcactttcctgagttctctgactcattctagcaaattatcactgaacctgaagaaatggtaggaacccccaaatttgtggacagttggtcagaaattcagtggtctaggaaccctcaagcctgcagctagtttctgatgtgagggcagtcctgtgggcaactgtgcccttagcctgtgaagtctggcctaactcccagtagttagtgtcagaactacactgcaattatgtaacaaataacagacaccatttcatacatatgtgtcaagtactgatatggtttggatctgtgtccacacccaaatctcatgtcgagttgtaatcgccaatgttggaggaggggcctgatgggaagtgactggatcatgggagtgggcttctcacgaatggtttagctccatcactttggtgctgttctcatgatagtcagtgtgttctcacaagatctagttgttcaaaagtgtgtactacctcctcgtctatcttttcctcctgttccaccatgtaagacgtgcctgcttccccttcaccttccaccatgattgaaagtttcctgaggcctccccagaagctgagctgatgacagcagcaggcttcctgcacaacatgtggaactgtgagccaattaaacctcttttctttataaattacccaatctcgggtatttatagaaatacaagaaaagactaatacaggtactatgcaagtatttttacatgcactattgctaaatctttagaaaatattatctctaggcctcacagtaactccataagacagaattatcatcctaattttataaataagtaaactaagcaataaaagtgaccatggccagtaagtggggaagcctaaattcaaacttatcaggactgacttcaaagcccatggtctagacacgacatacttcagtttctcaaattggttatataaacgtataacaaggtggccacctaagaatgcatgatactcataatttttttttttttttcttgagacggggtcttgctctgttgcctagactggagtgcagtggcatgttcttggctcactgcaacctccgcctcccctcccaggttcaagcgattctcctgtctcagcctcccgagtagctgggattacaggcatgtgctaccgtacccggctaatttttgtattcttagtagagacggggtttcaccatgttggccaggctgctctcaaacccttgacctcatgatccacccaccttggcctcccaaaatgctgggattacaggcatgagccactgcacccagccgatactcataatatctttattcaaattattggctgggctgtcacagtaaaatctaaagtattctttatgaatttatgaactctatatgaaatactgtattttaacacagattcctttagtcatcgcttaacttacttgtttgtgttttagaagcatgtttctggagaaaatcaactatctgagccaaaaccttcttattacaatgcgttgataatttttcatcacattcataacacctgaaaaagtataaaatttaagaaaatattatgaaaatattctcaataattttgcacatcagataacaaagttggtatttagttacttttgtctttaaattacatgggagggaatacaaaggggaagccaccaggtaagtctagagaaataagcagaggacaattcatacagagacttacagttgaaatgaaagttttggcagtttatcttaggtataatgaaatgccacgagagggtttttaagcagggccatgatatggtccaacttacactttatttattttttatttttgagacagagtctcgctctgtttcccaggctggagtgcagctgtgcaatctcagctcactgcagcctctgcctccagggttcaagtgactctcctgcctcagccacccagtagctgggattacaggcatgcaccactacgcccagctaatttttgtatttttattagagatggggtttcaccatgttggtcagactggtctcgaatgcctgacctcaagtgatccacccgcctcggcctcccaaagtattgggattaccggtgtgagctaccacacccagccccaacttacactttaaaaacatcactctcactaatgtgataaactagattggagggattggagggcattaggaagagaaacagattagtatagtagcagaggatctggagagaaatgggcattctttatatacatatttgcaggtagaaacagtaacaaattagatataaaagaggagggaaagggaagtgtcaaaataactgccatgggtagggagaagtgagtgagacaatgtcagcgattctcaatgttgttgagaatcactgatattctcaatgaggagtgattttgccacctaggggacatttgacagttttggttctgacaactggtgagaggtgagaggaccactacttgtatttaagtgggtagaggccagggatgctggtaaacatccaacaacgtacagaacagcacagcaaggaattaatcacagaacattaacagtccaaatgccaatagtattgagattgagaaatcctggcctagacgaaacaagacttgctgtgagttgataatgtttaaagctggaaaaacaacaacaacaacaactgaagctggttgatgggtataggtaaattcattataccactctgtctacttttgttaacaggctaaaaaataaaataagataaaaagggggaaggaaataactgccaggcttctagcttgattacatatagagataggtaagactcaaagaaatagctgttctattttgcttggcgcttatttggaggcagagggttaggaaagacattttcaaaagcacattccaattcagaaaactaccctcaattaagtttactcattaatacatcgtattaatttgtttcttctgtatattataattacctgtttcctttatcctcatgagatccagtgatcatttaagaacatgtgttggaaagtgttcaaagtgttttataaatgtaatgcattatggccgggtgtagtggctcacaactgtaatcccagcagtttgggaggccaaggcgggaggatcacttgaggttgggagttcgagactggcctggccaatatggtgaaataccaactctactaaaaatacaaaaattagcagggcgtggtggcgggcacctgtaattccagctactcccagcccaggaggcagaggttgcagtgagccgagatcacgccactgcactccagcctgggtgacagagtgagattccatctcaaaaaaaaaaaaaaaaaaaacataatgcattacaccaatgctacattacatgttcacaatcttcttacccacctttttctaattcagtaattcttaaactgtggtctacagaccagcagcactggcaacacttgggagcttgttaaatgcaaattctctggctcctccaccccagaactactaaattagaatttctaagactgggatcctgcaatctgtcataacaagatctccctgagattctgatgcacctagagtttgagaccactaaagtgaaatccttattgaactgccacactatggcaccattgctgtctccattggttccaatgcatcatttatatattaagttccctctgttctttcgtcattctccccagtactactacttgggactcacaacaacaaataaaaacacaaatgcagctggtgcccaacccttctggctgtattaaagatgatgacctcttctgtgagccaaaatacccttatattaattttagacaaaatatttttatgttaaagaaaatctgagactcctgaaaattcattcaaggaacccttaggagtccatagattcaagttggaaaattattgtaaaacacagaggaagcatttcaacatagtgtccatttatactaccaaaacagtgtgatatgctaataagaaactagaaaataaaaaaacttgtttttggtttttttgaaacggagtgtcactctatcacccaggctggagtgcagtggcaacctccatctcccaggttcaagcgattctcctgcctcaacctcctgagcagctgggactacaggcgtgcgccaccatgcccagctaatttttgtatctttcgtagagacggggtttcaccatattggccaggctggtctcaaactgctgacctcaagtgatccgcccacctcagcctccctaagtgctggaattacaggtgtgagccatcacgccccacaaaaaacttgttttagtacctggatttttacttcataaccacaaaaaggtaaatattacatagtttccttacaggtaacataggaaactggactagattctcaaccaggattaaacagcagaatgacctgaaaagtttttacaagctacttatgcccagctcttccctctcccttcagaaaatgacctgactgcttgaagtatcttccttctctacaacactagaattctgtattagcaagttcactaccaaaaaaatcaactaaaaagaatttttctttacattatacaaggaaaatgatagagaaaagtagaaaggctgggcgcagtggctcacgcctgtaatcctagcacttggggaggccaaggagggcatattgcctgagctcaggagttcaaagaccagcctgggcaacatggtgaaaccctgtctctactaaaatacataaaattaggcaggcatggcggcatgcgcctgtggtcccagctactcaggaggctgaggcaggagaattgcttcaacccacgaggcagagattgcagggagctgagatcacgccactgcactccagccttggcgacagagtgagactctgtctcaacaacaacaaaaagtagagagatagttaaaatttttccaatttaaattttatattcacaggtaatattaattttcttgaagtatcccatagattgtgttcaggttaaaaaaccataagctgatagaacatctttaaatattttaccttaaaagcttaaagaaaaaaaaaaattggggggctgtggttagtggacacaagaactaacaaaatttaacttaccatataatccatgtgctcagattaattataatacaatggggctctgttctggaactcttaaagtgcttcaatgaatgttggctttctgagtttttaccacatccctgaagatgaacagaattttattttgtatgacttacaaatgtttgtttcaaattaatcaaaacttaaattatactcacacttatactgaaaagttttgtttttaatttcaggccagaggagaaagtttcaaaaaagtaatatggattctcattaaatttaatttcttgccaacaggctaacatgctcaatatacagtatttacctaaaacaatcatgggcaaagttaatttccctatcatttaaaaatgtgcacactgtggaacacccagcatcctggcaggccagtggtgcccttctgcaaacacacatttcccaatcccgtacacaacttcaccccagcctactgagaactactgagacacagaccaatcatagcgatttccctcactaggtaagtaaagaaatgagatgcaattctggttaatgcaacatgaggggaagtcaaatccgctgaatctttccagaaggctttttttttgtttgttttttaagaggaacacaaccatgaggttgaggatggcacagcagaaaacagaataaacctcagtttttaatgttctttccattaaattaactaatcctgaagtggccttacttctggacattttgtgtgaaataataaagatttctcttatttttttaaaaaagtatatacttttaatttcattaaaaaaattcctttattacagatatcaataacttttaaactttaagattttaaattactttgcaaaagcagcagaataatctgttttgagagagaaaaaaattaatctgaaaggtagatccatttcctaagtaaatacaaaaggtaaagactggtccagatatgggaactactgcaaataggttgaattacctctgcaagtatttataaaccacacctgattactttctgaacatagcataccttttactttaccttaacaatcatttttaagttcattcctggaaaatttctatctaaattggaataaatttatcttaactcctatgcatgaccaacagtccaactcacaataagcatttaaggaaaacatttcagacaaactcacatataaataatacttttcttacctggaagccacacttgaggcacaaccaaatatcagaagtaagtactagctgcccatcatagaatcttctttcttttaaacattctgagcaaactgaccacagattctcagctattgctctctttacatgattcacgctgatagcatgacttacatgttggcaagttaaacctactgaataagataaaacaaaatctcaacattttctttgctacaccaaagtgctaccattactgagcaaacctcaaaagtattaaatgctgttaactaaaaagcacagagattgaacacacaaaataactcaaaagatatatgctatataattccatttatataatgttcatgaaataacataattatagaatgagaagagattcatggttgtagggagcaatggacgcaaggcagagggtgttgctataaatggacagcacatagagtggtgatgacacagtcaagtatcttgattggtggtggttatacaaagctatacatgtactaaaatgggatgatgtttcgatagccagtttgctgcactgaaggatgtctgaattatctctttaaatatcattaggaccttatctgatgtccctaatttattagagtttaaatttttgaactaattttagattcacaggaaggtataaagaaatatacaaggaggtctcattcacccttcactgagcctcccctgatgttaatgttttgcactgctatagtaaaatatcaaaaccaggaagctgacgttggtacaatccttagaacttattcggatttcagaagacataggcactcatatgtgagtgtgtttgtgtatagctgtatgcaactatgcatacctaaaatggaaaaaatatattaaaaatatccctttaaatggagagaactagcaagaaagtgaggaaaatcctcagaggcccaaatcaaaagcatgaggctaaagagaaaaccaagccctgaggccagcagctcccaaaagccatctgccaagctctggtggcttggtgacatggttttaataggccatgagaaagagaccaaaaaaaaaaaaaaagccaatctaagttacttcatgttataaactaaacaaaatcctaataaaaatgccaacaggattttttggaactagaaaaggtgattctaatatttatgcagaaaacagtaaaaataaagagtaacagatttcttaattaaaaacatatacagtcttccctcagatacttgaggcagggaggtggggtggggtagttggttctaggacctccccacatatacccaaatctgtgcatactcaagtcccgcagtgggccccgtggaatctgcatttagaagtcagcctgccaagtatgcagttttcacgcatcccaagaatagtgtattttccatctaggtttggtggaaaaaaatttgtgtacaagttgatcctcagcgttcaaacccatgttgttgaagggtcaactgcattgttatttcttctcaacactatttgggatgccatatatcacaatttaccagcaatatcatctgaagagtcttcatcatgaggtacagtaggccttttacttcttttggctttctcaggtaaagctttagttggatctttcacccgcatctgttatttactgaagggattgagggaaaaaaattcatacattttagtcttcaaaattaaaattttatattttatttaatgtgtattaaaactgaaatgacttcaatttcaactggtccgggaaatcaacagaggaagaagaggggaacatcacttgaaatgaaataaatctttgttaaatcagtatacacatggtatattccattggcttttgccaactataccattatggactaaatgtttgtgtccccactccaaattgatatgttgaactctaatccccaaagtgatgatacttggaggtgaagcctttgagaggtaattaggtcatgtaggtggagccctcatgaatgagactggcctcttataataagaggctagaaagctacctttgtatccacatgaggatatacgagaagatggccatctataaaccaggaagaaggccctcaccagatactagatttgccagcatcttgaccctgtacttcccagctcccagtattgtgagaaataagtctgtgttgtttaaaccacccagtctataataatttgctataccaggctgaaccaagacacaacccctaaatatatgatgtccaggtgaatgaccaaaactaaagttttcatcaacggagtaagtattgcttctggataatgagttctctttaccctttcctcccttctgctagcaaggaaatagtaggagctggatgagccatactggatcaaaaatggatagctgtaagccaagcatagtaaagccactctatacctgtgttgtacaactagcactggaatattaagagaaaattaaatttctatctttttaagctactacatttttgggggtttttcactctagctttttatcatgaaaaattttaaacatctacaaaagttaaaagaacagtataatgaacactcatatactaattagattccacatttatattattattactattattattattattattattttgagatggatctcggctcactgcaacctccacgtcctgggttcaagcaattctcctgcctcagcctcccaagtagctgggattacaggcgtgtgccaccaggcttggctaattttttttgcatttttagtagagatagggtttcactgtgttagtcagaatggtctcgatctcctgacctcgtgatccgcccacctcagtctcccaaagtgctgggattacaggcgtgagccaccgtgcccggctattattattttttgagacaaagtctcactctgatggcccaggctggagtgcagtggcctgatttcagctcactgcagcctcaacctccccaggctcaggtgatacgcccacctcagcctcccaagtagctaggactacaggtgcacaccacaatgcccagataatttttttgtatttcttagtagagatgggatttccccatgttgcccaggctggtctcgaactcctgggctcaagcaatccacatgccttggcttcccaaactgctgggattacaggtatgagccatggtgccccaccaattccacacctattaacaattagctatgtttgtttttatctaaatatcaatatgtgtgtatagagagacacatatatgtatgtgagtgtgtgtatatatatatatatatatatatatatatatatatatatatacacatagttgaactatttgaaagttgtagagatcttgacagttcatccctaaatacttcagcatgtatctcttaaaaataagcacattctcctatataacaatgtaatcatatctaagaaaattaataattttctaatatcatctcatattccatcatattctaatttccttagttgaccctaaattgtcttctatagctggttttttgaaaaagattcaatcaaggtttgcacttgatattggttatgtctctttagtatcttttaatctattaacagaacagttcttccaacctgttacttgcctaagactttagctttttaaagagatcaggccagtgcatgagtcaccttgagggtcttgttaaaatgaaagttctgatgcaacaagtctggcacaagacctgagattctacctacctaaaaagcttctaactgaagccactgctgggggcccatagaatactctttcgacagcaaagttatataatgtctcacactgaatttgtctctttcttcatagtgttatttacctctatcccttatatttattaaaaattcagttaattatcaaagattttagatacaagctaagcattttttaaaactactatattttggagtctctgttagagtagcttggcctaccttttactctcctgcctggtggctaagcaacatcgcaattttcatggttgctgacttacttctcaatgatcaaggtaatgaatctttcaattcagtactaaattccaaatcttgatttattcattccataattcacaataagggagctttcaagtttaccattaagtccaacggtcatcactactgaactaagttgcaataaattaagggcttccgggttaggaacatgtaaaaagcctctgagttccttgagcacttcatctctaccttctccctccaaacttcctcatctactctcccctacagttccaccttataaaatcactaatttaagtatccccttctctgacagcaacttcccagttcttccaacttgcctgatcagccactcatattttcctatagtgtccaggctgacaagaggctgcatctcaacaagtccttccatgacccttacagcagggcagggagaagtggaaatggcaaatggagagctgcttcctaaagcaagtcacatggcacatttaacttcaagcagacatggagaggggttgcccatgtacaaagagtgcagcattacatgtacccaaaaataggtgaaccggaatacttgtgcagagccttaaggactacatcacctctctcgcagaacccaatcctagatgaacccaattaaccattttctccatgtcgggagaaagtctcttaagaaagcagactaggtccattattattcacttcaccttctggtcaacttacatactatccacagagccatttcaaatcttcttcactttcctcaaacctctaacccctccaactcccaactaacttaccaaaaactgatctagtcttttataagggaaaagagacataagcagacggcaaatttgatctttctaaccccaaatttgcaaacctacctccatcaatttaaatttgatgtcctgaaaagagataggtataactaataaagtacagggaaaatggcctatgagaaactgattatattttctcgctgtggtacagataagctcttgataaagatgagcattaacacagataatgctagcaaaataataaacaaaaccaggcatttgacctacatactgtaagcaacctgtgccttttttcaaaaacactgactcaaaattaacttggtaatgtagaggcaatttctgatgatttttctgccatatgtaatgtctaaacagacagaatcatttggtacagtaacccagaattcggcaattatttatctgtagttttccaatttccatttgaggcaaaagggcaaaattaaaagtccaattattagagcttccaatactttttatcatcaaaattgtgtctgggcactggagactgggaaggatgggagtggggtgaggaatgagaaattgcttaatggacacaatgtacattattcaggtgatggttacactaaaagcccagtaccactaggaaatatatcctcgtaaaaaaacggcacttatatcccttacctttatacaaatttacaaaactgtggctgaggatctccgtgatctcccccacatttagagctttgataggatgcacgggactcaacatatagttgaattcatggctgacatttattacacaatgcagtatggatataaaggctcatcataatagaaaaagacacaagcggagtctggaggaatcacgtgtaggctccttatgcggtctccctcccaagaggggtcaaacaaaacacatccttcctccatcagtgaaaatgcagcagtttccgcgcagggaagcccattaaagacttggtgtcccggatttttacagaagctggtaatttcggcataaaacatactgttcagcacaaacccaaaaatctaagttcccagatgccaaacaagcaccaacattgcaagcagtcctttctaaggatagcagtcttaaggcctgctatgttaactctttttagcacaaatatgttctggccatttttctcatgcggttttccaaacaataaactttacagttttcaagtcaccatcacttaacacttgtcttttctctaaagtaggatgtgcaactaagttgtttagaaagctttgtttttaaacaggctatgcaaaaagcccatatccttaagaaaaaaaaatccttttttcctactcttgggcaattatttatgggggttggaaagagaagaaaaggtcactatctccttttatataccaagctcaaaaagatgagcagcacttatggttttgctgtgtatcacgctcagttctaagcacttcacaaatattaacccacgcaaccctcacaaccaccttaggagataagttgctattattttccgcattttacacttgaaactgagaaagagaagtgaagtgacttgcagaggtcccaaagccagtaagcggtggatggagatgcggacccaagcagtccggccccggagctcctaatacacgacgcttccagaaaagtcattagacaggcttcctccggtcaccaacacacacacaccccgaggatgtgaagagaaatgcgccgcgatgaggcggacggaaaggtgtggggccgccgcgcgcccaggtcaccaggggactcgggcccctcccaggccagccccgacgcccagggcttctcccgcagccgcatggacccggagccggcagagcggcgctcacacggccctcggtgaccgcccggcgcccccagggatcaggaagccgagtggggtggggagcctctcttccagcctcgcccacccacaagggggtcaaggtcgccgaagcgaagaccgagaaactgcggcgaccataccgccgctgcgaccaaagcgccgcgttctcaactcaccccgccgggccgggccgcagcgtctacaacctggggagactgcgcctgcgcgctcgtcccgctcccggcagaggtggggcctcgttcgcccgcccccagccaggaccgggagggttccaggcggcgcgcccggggcccgggagcgcggggaggggtgaaagggcggggccggcttgcgtggcgcctgcgttctgcgtgtccgcagagcccggagagtccctgataatctaagactcatagccaccgactagcaatttgttaggatcctgggccagcgtgcgcacctcggatgttgcaggagtccggcttaagtcccacttgttgctgggcaccttctgaaacagcctccgatttccctccgttaccctcctctgaactcttttttttttttttttttttttgagacggagtctcgctctgtcgcccaggctgcagtgcaatggcaagatctcggctcactgcaacctccgcctaccgggttcacgccattctactgccttagcctcccgagtagctgggactacaggcgcccgccatcacgcccggctaattttttgtattttgtttagtagagacggggtttcaccgtgttagccaggatggtctcgatctcctgaccttgtgatccgcccgccccggcctcccaaagtgctgggatcacaggcttgagccaccgcgcccggctccgcccccacacccccgccgccccctgaactcttaaagtcacatctaacattcgtcatatattattgtggtttttcccccattgctgttgtcttacctatccttctctcttcctagctagatagtacatttcttgaaatacacctatacctcctcaaagcccggttatctgttgaagtggccagcacattgcatgtttagtaaaagtagttggtttgaaaatattttgtttcaatcatggatattgcaaatgccaacactggttatggataggttctaaaagtctcctgatctttcacaactcttcagccaagggacaaatgtggctttaaggataagagcattggcgtagaaatcagaagatacgagagttaaaattgcaaacactaaatttttctttaaaaactcttctaacagtatttacatgtggagaacttggcaaagaaggttgatatttgcttatatcgtacttaacaaggaccattcatttaacaaacataattgagcacagatatgccagttgctgttacaggtatagaggtacactatcattttggggttaggataatttttttccctagggaaaaagaaaatattcctcaaataagaagaggtcatgtggtgtaattttgaaggcaaaattgtctacttcataaatcaaaagctttcatgtattttaactttggatttgacctagaacttggaagaacaagaacaagcaaacttgagcaaatctaaataatttgcatcttaattgtgtcactgtaaaagagattttaaaaaatatatgtggaaacccagtttatgattgattttttaaaagggattgaattagattatggaaatttaggttcttttcttcataagaaaaaaattagaaattatcaaataccatacaatacttaaattttcttggaaacgacaaaattcaaagctatcttgatttccactagatagacccttagcataaccaaaatctccagagatttcattctttgtttcaaaacttggcataaattaaggaaaattctctaacactattttattttatttctgatgttcctcatttaccttttcacttaattgaatgtaaaatttactacttgatggattattcaaagaaaggaaattatttttaaatattactcagtaagtatgttttagtgctattacaatgacattataacaaaacatcaaataaaaatatagattaccttaagattacctaaccatgtattttccaaataatgctaaatatcttaaatttaccatcatgttctgtttggaaatatggggaatctttgttaagctgtaggctatatatattcctcttatatttctatcaagtgtatttttttcctttttttgtttttttttgagacggattctctctctgttgtccaggctggagtgcagtggcatggtctcagttcactgcaacctctgcctcctgggttcaagcaattctcctgcctcagcctccctagtagctgggattataggcacttgccaccacacatagctaattttttttttttttttgtattttagtagacaaggtttcaccatgttggccaggctggtcttgaactcctgacctcaagcaatccatctgccttggcctcccgaagttctgggattaaaggtgtgagccaccgagcccagctcctttttatcaaacaccaaattgaaccagatatcaagtatatatttttaagatacactctttattttaaaagtaatacctgctggtttctcatcttcccctccttcccacactcccatttcctcttctctgcttgctgttttctgatatatagttttaggcactgtctttgtgcgtacaccaggcatttgtaccatgtttttatatgactacctttatgctaaaagataacacagcttagattacagtctacattctcttctatgacttgaatttttcacttcacagtatatgtcagacatattttcatattaacctatttttttttttttttttttgagacagagtcttgctctgtcacccaggctggagtacagtggcatgatctcggctcactgcaacctctgcctcccgggttcaagcgattctcctgcctcagcctcccgagtagctggggcaacgggcatgcgctgccacacttggctaatttttgtatttttagtagagacggggtttcaccatgttcaccaggctggtcttgaactcctgacctcaggtgatctgcctgcctcggcctcccaaagtgctgggattacaggcgtgagccaccgtgctgggccatattagcctcacttttttgagcagttgcttaagtctcttgtgaatgaatgtttttattttttcatcagtttcttgttagtgtacacttgtctttgcttactaacacaagtattctcagtaaattgttcactgtggaaatgctgagtcaacagatgttcatttaaagttttgataaaaattctttaaaaaaaagagaatcacatgaaaggccatacatttcctaatttttcattttattagtctgttatatggggacttaaagttgattttaaaagaaatgggtgtgaaatgactttattggtcaaaaataaaataaaataaaaagaaaagggaaaaatcccaagtctcttaaaaattgtcttccttctgccgggcgtggtggctcacttctgtaatcccagcactttgggaggctgaggcgggtggatcacttgaggtcaggagttcaagaccagcctggccaacatggtgaaaactcgtctctactaaaaatacaaaaattagccaggcttggtggctactggggaggctgaggcaggagaatcgcttgaacccgggagccagaggttgcagtgagccgagatcttgtcactgtactccagcctgggcaacagagtgagaatctgcctcaaaaagaaaaaaaaagaagaaaagaaaagaaaaaaaaaaaagaaaaaaagtcttctttccaatagcctttcactaacacatgagtaacaacaaaaaattaaattagttgtttgagaattaatgattcatatcaactcagcactagtaaatctttctcagaaaagtgaaaactatttctccctcttttatcaattttaagtcttgcttaaattattccttaacaatgatggaataacttggacacaatgatcaagataactaggaacaatgatcaagaacctcttttgacaagatctttttgctgcaaggactcttaaataaactaagtttagcagtgtgctatatatggaaaggcatatttatctcctcagaaaaaaaagtcctacataaaaatattttttaaataataattagttatgagccctaaaagaataattgtttagtaatacttctcctgcaaaagcagaaatcagattaaatattattcagtgaggccaagtatattgtttccctatcttgtgttcatactacctgtgatttatgatgtatatttagaatgaggatgccacagagactacatgaatctacagtatatagtgatatcttagttaaaagtgaatccacaaaataaattacacggagactatggttaagctccaaattatttggaaaataattataaatgatgtcattggtctagaaatctgaaatggtttatagcttattaaattattgataactgaagaatttaaaagtaaatgcttaatgaaatgattccttggacatacactttaataatgccatttaaacatgaatattttaattttttttttgagatagggtctcactcagtcactcaggctgatcacagtgcactatagcctcatactcctgagttcgggtgactctcctgccttagcctgctggtaactgggactacaggttggaaccacagcacctggtcaaatattttaatttttaactgtaaatctatttgcagttaaatatagcttttattatgtttgggaaccaacctgagaataaataaaaaataagataatgagaaactttatgtggtagttttaataatgacctcctgccccaaagatgttcatgttctacaaacctgaaacttgtgaatgtgttaccttaactggcaaaagggacttcgaagatgtgattaaattaagtatcttgagatgagaagattatcatggattatctctgtggtctgaatgtaaaggtccttataaaagagaggcagcagaatcagaggaagagaaggagctgtgataacagaagcaggagtcagaatcagggatttgaagctcaaagctgttggctttgaagatggagaaggaggccatgagagccaaggaatgcaggcaaccactacaagacagaaaagacaagtcaagaaattctactctggagctcagaagaaacacagccttgctgacaccttgattttagccaagtgagacttctaatctacagaattgtatatagtaaacttgtgttgttttaagccagtaaatttggggtaatttgttacggtagcaataggaaactgacacatattatacaatagttggacataaccctgacaaagctatagtcaaatatcatcaattcgtggaggaaagatggtaatatgacgttattttaatgcctacatcagttgagccagctatcagagttaagaacaattcctagaaaagttatccatgtagtcagtctgttttaaacaaatccagtgtatgaaaatcatgttataaggtaaattggaaacgtttatttcctttaactctttaaatgtgtcacactttttgctttctatttttaaactttgtgtctcctacaaaataataatcaaaaacaaaaaaagtaagcataacccgtagtttctttccaaatgcctttaaagtttcaaagcagtaattacaccttgcggcactacccggttcggccggtgcctggctggagggcgccggagagcctggagcagggcgccaggaggccggagcaggaggagaaggagtaggaggaagtggtcactagcgcggcggccgccggcccgcaatggtgctaccctggttgctgctcgagactgcgcgcagggcggtcctcgggtccgcggaggctgcgctctgcggtgagcttggtggtccctggggaaagggagagcgcctaaccttagacttcaggcaagggttaacattggtgggggtgctcgcttctttagacttccagttaaaagtcagacccatcactcttggcacctggggatgtaacacccacctggggaagatttcgggctacccgaacctgtgggcgctctggggacgcagggacagaggtaaacattgctccagcgaggtcgtatgggagggcgtttatattggtagtggtgcttgactgagcaatacatgaaagccaatttcgcgactcagaggagcgagcaagatggccactccctgccggcgagagtcgtaatgccgagcccagccttgcgagttacatttgtgacccgctacagagcagcgctcggcgcttcatgaaacagccacctagaactataacgtgttagaactataaaaataccacccctcattttaccgatgagccagcagaagccagagaaatgaaggtggttaccggaggcgttgggtctagaactcaaagcagtcccttcttttcgctttgcatgctgcctctccagcaccaacttttatctgtggatgcagctacagggacccagcattaacacagcttacccccagccccacctacctattttaactgttggtaagtcctctgtagtttaagatgtgcttttctatgcaaattttttttcttttctccttttttttctttctttctttcttaagaaacagagtctggctctgtcgcccaggctggaatgcagtgctgcaatcacagctcactgcagcttgaaactccttggctcaagcgatcctcccctcagtctgcacgtagctaggactacaggcggaggccatcaggcccagctgattttgtttgttttgtttttgtagagatggggttttagctatgtttctcaggctggtctcgaactcctggcctcaagtgatcctcctgcctcggcctcccacagtgttggaattacaggtgtgagctactgctcctggccacagagtgtttcctttcacctttattcaagaatcatttggtggggcgcggtggctcttgcctgtaatcctagcaccgggaggctgagctttttgaggtcagaagttcaagaccagcctggccaacatggcaaaactctgtctgtagaaaaaattagctgctcttggtggcacacacctgtagtcccagctacttggagggctgaggcaggaggatcacttgagcccaggaggtcgagactgcagtgagccaagatcacatcactgcactccagcccgggtgacaaagtgagaccctgtcttttaaaaaaagaatcatttattgagctctgggactggcgtggtggctcacgcctataatctcagcattttgggaggccaaggcaggaggactgcttgagcccaggggttcgagatcagcctgggcaacatagtgatacccccatctctactaaaaaagaaaaaaaaaaaacccagcatggtagcacacacatgtagtcccggctaccggtgaggctgaggtgggaggacttgcttaagtctgggaggtctaggatacagtgagtcattattgcaccactgcactccagcctgggccacagagcaagactttgtctcaaacatgaaaaatcaatcatttattaagctcctaaactgccgggcttcctgctggggatacagcctctgcagctcagttcacccatttctagggaaggcagacacaagtaatcaccacacacagcccagtcaagtgacactgcaatggaaaagaacaactgactctgagttctagaaaatattagaaaaaggtatcttttcatttaaattatgctgtaatacaaaaatcagccaagcgcttgtagtcccagctactaaggaggcttaggtggaaggattacttgagcctgggagatcatgccactgcacttcagtctggtcgccagagcgagaccctgtctcaaaataaataaatatacatataaaattacgctagtggttgggcacagtggctgacgcctgtaatcccagcactttgggaggccaaggtgggtggatcaccttatgtcaggagtttgagaccagcctggccaacatggtgaaaccctgcctctactaaaaatataaaaattagccaggcatggtagcacatgcctgtaatcccagttactcgggaggctgaggcaggagaattgcttgaacctgggaggcggaggttgcagtgagccaagattgcactattgtaccccagcctgggtgacagaacaagactccatctcaaaaaaaaaaaaaaaattatgctagtattaaatgattctatcctcatatgaaaacaaaacacaacatattgctcctttatatatcctcctcttcccactcttctccccagatatggcttgatacacatccttctaaacacttgtctatgaatatacataaataaaagtacataaaaatactgtatatacaaatgtgatctgtgcatacttttctgcaattttttctcaggtattcagaagccttccatggcggcacatgtaactctcttaactgctgcatatattccaccatttcaccagtcacctattgatgaacattttgatttccaatttttttgctattataaagttgttcagtaattatcattgtacataccactttgtgtatttgtacaaatattttactaaaatagatatctagatgcaaaattgttagattaaaggagaggtggcaagggacatttaactgggtcttaaaggagagtaagagtgttccatggagagatgagggagaaaggtattcctttcagaatgggcagtatgtataaatcacgaaggaaaggcagaaatagatattgattgattgcactgtatatacattaccttacttaaagctcataggtttaaatgataataatattcctattttacaaataagaaactaagtcctacaaattttaagtaatttctgtagggttacagggataagtgggtaagccagaatgtgactctaggtttatctgactctaaaatcccttctcttttcattataaaactgtatttagagcacacatatacttttttttttttttttttttgagatggagtctcgctctgttgcccaggctggagtgcagtggcgcaatctccgttcactgcaacctctgcctcatgggttcaagtgattctcctgtctcagcctcctgagtagctgggattacaggcacgtgccaccacgcccagctaatttttgtattttcagtagaggcgggagtttcaccatgttggtcaggctggtctcgaactcctgacctcatgatccgcctgcctcggcctcccaaagttctgggattacaggcgtgagccactgtgccccgccaggagcacacatatacttttgatgtagctggaggatagagcaattggggcctaagaggagaaatgaaaggaggagtgggtttggtaaactgtgctggtaaggggttgttgaaaggcattaaggaacatactaaggagcttggattctatcctgtgatgtaatgctgcagtgacatccaggtgatgttaagtctactaatgtggaaaccacaaaactggaggttattcaaaggttaggctgaaaaggtaaaaatcaggtgcagtctgtattactcttgaaaatccctctagagaaccacacatcatctctcagtaaatcccaaatagccagtttttcttcaatataggaacagattagtgtttctttgagcacaagatgaagtggttgatttgcaagtggagcacatgctgtacataaaaacacacactattggctttaaataattagtatgcaatagaggctcatatcatgagaggcttgggggagctgagcctcatcaaacaaataggcttacttcaggcttttgctcactgagtgttcactggttcgagtgttcactggttccagtgttcactggttatttcccccatcctccacctcccaataggagtataattgaattatagaaagttaaatatcagttagatgactacaagaaaaacataactatttgatccagttaaagaagttacttgctgtcactgtctttcacagtggctaagagccagaatcttgagtttaacataaattataaaattaccatagttttctagttcctaacaatgagaagcagtaatgagcattaattcagcctgctggctctttatattctgggaattcagaaaacagctagctggatgagaaacagtttgattccaggttaagatctaatgttgtagacacagtgaatcaacttttcaaatctgaagggggtgaggaaacctatatttttatttttaagttttgtttattgtggtaaaatatgtataaaatgtgattttaactattttgaatgtacaattcagtagcattaattatattcacagtgttgtgcaaccatcaacactttttatttcagtgcaaaaattttcatcaccccaaacaaaaactccccattcctcctccccccacctcctgacaacctctaacctactttctatgaatttgcctgttctatatatttcatataaatggaatcatataatatttgtcctttgcatctggcttatttcactcagcatgttttcaaggtgtatccatattgtagcacgtgtcagtacttcatttttatgactaatattccattgtatgtatacatcacattttatttatccataatctgctgatgaacacttgggttgtttccaccttttggttattgtgaataaatataagcattagtgtacaagtatttgtttgagcccctgttttcatttgagcatatacatgggagtggaatagctggaaacctgttcgtttaaacctttatagctatttgtccatttttatgttactttcctagccatgaaaatgacagatgaaaatagaaaagtgtggctggtctgaaggtaagtgagttacctcaattgattgtccagtcagttacagatcgaacttgttctactctttccctccttctcactactgcacttgactagtcttaaaaaaaaaaagaaataaaacaaaagagtgtctgtttttcataagaagatacgctttttttgcaacttacttttgtcttttcttaactacttaatacatggaactgctgtttatttcttttggcctatgagccctgcaaaaaattaccaaggcattaagagcattgtaaacccagaaagtttgggaaccttaggtttatacataatgttcaacaactagttttttaaattcaatactattttggacaacttacattaaataatgcatatcccattgtataaatgtaccacttataacagttgccttattgatgaacttccagcttattgtagttttctaatgttacaaagaatgctacccacaaacataattgcatatatatacatctgtattaactcatactaaggtttctgtaggatagattcctaaaactaaaattgtgaggtaaaaaggatatacatacttaaaatgttattacagctaaatttcccttcaaaagtttgtgacattatacactaccagcaatgtatgaaagtacccatttcctctttccctcaccaatatttgatattataaattcttttaatttttacaaacctgacaaaataacaaaattttgtttatatcttgtatttccttaattagtagtgagatcgggcaccttttcacactttattggctatttatatttctcctgtcaatccacgttcatatattttgaccatttttctatggggatttttttctttttcctagttatttgtatgaactctattttattaacactaatcttttgttttttttctatgttacaagaattttcttcctacctgttacttgtattcaaaatgttcattgttctttttccatatataactttagcatttttatgagatcaaacctttatgatttctggtttttgtcatgtttagaatggccttcctatcctaagacttaaattatctactcatgttttctatgagtacttttaagatattagattttagggccaggcactgtggctcacgcctgtaattccagcactttgggaggcccaggtgggcggatcacaaggtcaggagatcaagaccatcctggctaacacgatgaaaccccgtctctactaaaagtacataaaattagccgggtgtggtggcgggcgcctgtagtcccagctactcgggaggctgatgcaggagaatggcgtgaacccgggaggcacagcttgcagtgagctgagattgcaccattgcgctccagcctgagcgacagagcgagactccatctcaaaaaaaaaaaaattagattttaggtttatatttggaatttaagcataaggagtggggtaacagcctgcttagtttagtgttttcccgtacttagttggcctatttattaaatataatgtcattttcttattaatttgcaatgtcactgttagcagatactaaattctcatataaagtatattgtaagtctcttttctggacttagacttttaaaccttttcttatgccagctctacactacttaaatcaattttactatatttaatactttaaacaaaatttgaagcatacctgtataatttaccttttttacttttttttttttttcttttgagacaaagtctcactctgtcacttaggctggtggagtgcagtggtgccatcacagccttactgcagcctccacctcgtgggctcaaacgatcatcctgcctcagcttccctagtagctgggactacaggcaggtgccatcatatctggctaattttttaagaaacttttagtagagatggagtctcactgtgttgcccaggctgtctccaactcctggactcaggtgatcctcccacctcagcctcccaaagtattgtgattacaggcgtgagccactgcacctggccttatttacctttcttatagtggtcattttgttgtgaaatatgaacattattaatttttttgttattttaaaaatcttttggatattcttttttaaaaaatgattttagacctgtagaaaagttgcaaaagtaaaagtttcctttatgcttaccaacttcacatagtatgaacatcttacatagtgcaattactgaaatcaggaaattaatattgatataatactattaactaatccacagcctttaatctttcttgacattgacacttttaaaaagggtactagttactttgtagattttttgtctgaggttttcttctaattagattcaggacatgaattttttttgcaagaatactaaggaagtgatattgtgcactcttctcagggcctcatatcaggaggcatatgttatcaacatgtcttattactagtgaagttatctttgaataactggttaaagtagtatctttcaggtttctccctttgtaattagtatctcatggaaagatattacctcatttctcatcacactttcactcactagatctatatccatcaatggtttttatctgcaacaattattactggagtgtttgcttaatggttttctgttcccatcattccttctatatttattagttggaagttcccatataaggaagataatcccttctccccatttatttattcaattatatccttttaccagtatggacccatggatttattttattttatgggttccaataccatattatgttacaatattatattacgataccatattatgtaacaaaatgttggcactctgtatctgcaggttcgacaccagaggattcaagtcaactagagagaaaatattcaggaaaaaaccaaaataacaatacaacaacaacaaaaacccaaaaatacagtataacaattacttacatagcatttacattgtactaaggattatatgtaaatgagatgatttaaagtacacgggagatgtgcctaagttatatgcaaatgctatgccattatatataagggacttgagcatccacagactttggtatccaagggagtactggaaccaatccccttcagataccaaaaggcgactgtatttaagagatagaaacggtgtcaggccgggcgcagtggctcacgcctgtaatcccagcactttgggaggctaaggcaggcggatcacgaggtcaagagatcgagaccatcctgaccaacatggtgaaaccccgtctctactaaaaatacaaaaattagctgggcatggtggcatgcacctctagtcccagctactcaggaggctgaggcaggagaattgcttgaacccaagaggcggaggttgcagtgagccaagattgcgccattgcattccagcctggcgacagagccagactccatctcaaaaaaaacaaaaaaacaaaaaacagtgccattaagtacttacaagtgtagtataaaatgtaaggtccccacatctaatctatggcttaatatctttgcttgcaaggggaaatgaaattaaaattttcttaatattgtaacttggattaagatttacagattatttccataattcacttaccagatgctgaatatgtatttacaagctcccaccaattaaggggcttggaaagagtaaaatatggaactgacacaaggcccatatcaaacattcagggcagcacaggctgcatcctgatgctcagtgtcaggatacatgcatacatggaaaaactcctttctcttcttttgagatggagttttgctctgttgccaggctggagtgcaatggcacgatctcagctcactgcaacctctgccccctaggttcaagcaattctcctgcctcagcctcccgagtagctgggattacaggcacctgccaccacacctaatttttgtatttttagtggagatggggtttcaccacgttggtcaggctggtcttgaactcctgacctcaggcgatccacccgcctcggcctcccaaaatgctgggattacaggcgtgagccaccacacctggcctttttttttttttttttttttttttgagacaggttctcactgtatcctccaggctggagtgcagtgatgtgatcttggttcactgcaaccccacctcccgggctgaagagatcctcctacctcagcctcccaaagtgctgggattacaggcataagccaccatgcctggctgaaaaattcttttctgtactctcacaacacttttgacatcagatgtatgggttttccacaaccaagtaattctccagttctctgtggacactaactggatgttctaaaattttattttgaactaactacccagagttagcacagaccccagagcctaagggttcagtcccacaggactgcccctacctcagatgccagtcacaagtccaggcctcccactcttctgaccaactagctgtaaatcgggggttctcttaaccccttccttgggtttgatactttgctagaactgctcaaagaagtcagagaaacaaatttattgatttatttgaaagaatataataaaaaatacagataaacagccagaagaagacgtacctagtgggaagtctagaagggtcccatgcacagtagcttctgtccctatggggttggggtgtgttatcctcccagcacttgaatgtgttcaccaaccagaagctctctgaaccccatcagagatatttatggaaacttcatcatgtagtcatcagttattaactgagtctccagctgctcttacctcctggaggatgagaatggggctgagttccaagcttctaatcatagttgggtctttctggtgaccagcccccatcctgaagctatccatgaacccaccaagagtcacttcattagaacaaaagaatctatcacccaggaaattccaagggatttgggagctctgtgtcaggaagtggagtaaaaaatgaaattcattaaaacaaaagatgctcctagcaccccccccacccccatcactcaggaaattataagggttttaggagcttttgtatcaggaaccaggagcagagaccaaatgtgtatttattatgtcactgtgcaaaatacatacctagaatacatagtttattaaagcaaaaaaattaactatagttaactgactggaaccagggggaaattcttttaacctattctttccagctgttaatagtgatatcactttgaagttgcctaaattgtttattttttccaggtttgacgtcaataaagggaaactgccacaatttttatactgctatttctaaagatgtcacttataaggaacttaaaaacctgttgaattctaaaaatattatgttaattgatgttagagagatatgggaaattctggagtatcaaaaaatccctgagtctatcaatgtaccatgtaagtgacatgtgtcttaaattaatttattaaaaaacatataaataatttactatatctaaaatctaactgaaattcttaacattttctttcagtggatgaagtaggtgaagctctacagatgaatccaagagacttcaaagagaagtacaatgaagtaaaaccatccaaatctgacagctagtgttttct

SEQ ID NO: 481 - DNA, 23836 bp, Homo sapiens
ggtttaagcacagaatatttgagattgaaggaatagtgagtaaagcactatatggtaacacacttttgcatctttgatgtgggaaatggagaatttaatacaactaccatcccttcctttgacaaaaatccctcttaaagtggaaatttcagtttaaaattttgtgtgcctacaatttttttttatactgaagataaagatctttcaaagagtagcttttcctagcccaacacatgtttaattattatcaacaatagttgaagagattttcctgaaatattggcttagggaaatcaggatagtgttcagaacgtttaaactctctgatatcacaacctcaatatttcagtgacttcatataatcataatgttgtttttttttgtttcccacgcctcgctcagagtaatccaacacagttatccttacttaaaccattttcttccaagtgacaaggatccaggctctctccattttgtgactctaccttcctcatgctcctcagtgtcctgtccatttagtcagtagacagaaaaagaatggaagacggggtgtgggaggatttcacgagctgtacttgaaagtggtatatatcatttcttcccacactcttttagctataatccagtcatatggcttcatctaatcccaaaggaggatagggactgtcactgagctttgtgtttggtgaacagccagtaaattgggcaatttatctcttcatagataaggatttctattttctgagtttatttcttgtgagaacaaaacaagattttatactcactttatctaacattatctgcttttcaggcctgtgtgtgtgagcgtgagcatgtatgagtttaataaaaatattactttgccaaaacactctaaagcagaagtttgttttcattctaccattactatcttttcggcatcatctttctgcctcagggtgcacatcttttttgacttcagagttaggccagaacacagtgctcccatcactatattacacccggttcttcctagtataacagtactttaaactcctttctagatgtccagtcctcttcagaacgtacatgtctgttgttgcataattttaagtatcatcttgtgacttgttaatatgctaaagccttaatgagaaatagtataaagtttctcagaaaatggtccctaaatccactacatcagaatcacctgaggtatttgttaacttttgaaaatctaaaccaggaattgagaattgcaatctcctagagatgactgaaacctgcgtttaaaaaaccacttccaagtggctctattgcacatcaaattttaagaactaaaagctcagtggtactatcttccaagataacacatttcgattattacagtgaccttcatataatttcatataaccacataacaaatgttatatagacttcaactgagatcaaataaaacaaggacactgttctcctcacaaaactttaatattattcaactaagacaaacacccaagagacaaacatctcttgaattcaaagacagcacgaaatgtgaatgctgctcctaatacaaaatttaaaaatgaacaaggctgtcatttagattctttacaaataaacaggaaactcaggtaaaaaaatagcaaacggctgatagcaatcagaactgcaactaagttagatgagtttcctgtagcttccaggtgtctttataattgaaataaatgactccttaaaaaaaagcaaaataaattaaattatgaagagaaggatgcctgacaacagtttagaatatgtgtaaatgcatatatatttttaatgcatttgacacttcaagatgcctagctagataaaccaaaccaggtcatcagctttatactacgtttacaagataaaaattaatatttttaacagaaagtattattttatcgtaaagtactttaataaagatgtttttcttaatacctttcttattggaaactaagttttctagagatacataaaatgcaatgcaaaggcccaaatcatttcattatttaaatataaaacaaaaggtatgcctggaggggcatggaaccccatggtttcagtctgtcctatacaaatatatacagtacgtaatgatgattgttagaattatctgaatttttattagcccttcctttttgttgtgataacatttcttttactacttctactctttcatatcaacaccaccacagctgccaccacaccaagagttagatttagctagttagttcctgaaaattcttgagatgagggtagacacaggagtgaagtgggtaaaatagaaaacctcttcttataccaatgaaactttttataaatcaaatacaatttttattacttcctcaaaagaattagcgcaccctgctgctagtgccaaggatgacataggcacctgatgtacagcactttttctctttaaattccaagaatctctgaatactgttgaacataattgttaaaattcatgttattaagagtcttgttgaaaaagtatgattttgctaattaatgtgaaatagattactattctttaatacaaatattttgtattattctttattaatacaaacatttaatacaaattcactatggatgagttttttttctccatattttaaattcttggtctctgaaacgttgataaggaagctgttactcaggcacaagtgattctgcattgctgaaaatgcttcccaatgttcttaggaagtcatgagtctttagtgattaatataccgaaaaacactgagctgtgggatgggtggttcatcactttccagtaggtgtgtttttattttgattgctaactgtgaccatccaggaatactagtgccatttaactactttgggaattattttggtggctagaatgtacagctattcataattatggtaattgtatttttaagtagtgacttatttttaagtagaggcatttaagcatttagaaatagaagctccattctggtgccactccaatgttgctttagtgtatctaattgcctaaatggatttcagctctttagctgctgtcattatagcaagtcccaataataagcaatggttactcagggaaatgtgtttacttcgagaggatggaagcatttgcactgctttctaaatgtgaattctgcccagaactcataaatgtgctcatcgatggtgtgacttctttgatagctctatttcaatatactaaattgcacctgaagattatttgacaaagtaggaaggaaaacttcaacaggtttccatggcttcagggtgaagactttgaatccctatagccatcagggtaaagataaaaagcccttgtgaactcactattcccatttcctcctttctatcctctgctccaaactgcttggccacttgcattcctgattctatcagtctctcacttcctttatttcacttatgtttcccctgcttagtattacagattatccttggtgctgtcaaaacatcctgcttcttagtctttgaaaataatataataaacattgttttaatagaattatttttcataattttttttctttcctgactccaaatttaaactcaaagaaggtaggactattgagttttttctttgtttttttttgtttgtttgttttcgtgagatggagtcttactctgtcgcccaggctggagtgcagtggcgtgatctcggctcactgcaagctctgcctcccgggttcacaccattctcctgcctcagcctctcgagtagctgggactacaggcatccgccacctcccctggctaattttttgtatttttagtagagacggggtttcactgtggtctcgatctcctgacctcgtgatctgcccgcctcggcctcccaaagtgctgggattacaggcgtaagccaccgcgccctcccgagttttttctttttaaaagattcttagaacttatgttcagcacagagctgacattcaataaatgtttgatgaaatctgcctctggataatttcatctatttgaagctaagcttaaggggcagctttttgtaaaatattccctaatactatacaatgagcatttcgtaaataagtatatttaatgttgaaggtactggtgtatgttcatttgtggatgcaaagatgttatgtccctgtgtgtaggaattaggagagcaagtggttaatggcagggtctgaatctgaaaaataccataatatccttcaagtagtcactttttccatcttatttccattctccctggctatgttatgtatgtatatatgtataaagacatactgagagacaggactagctggatttcctaggcggactaagaattcttaagcctagctggggaaggtgaccgcaccgccctttaaatacggggcttgtaactcagctcacacccaaccaatcaggtagtaaagagagctcactgaaataccaattaggctaaaaacaggagataaagaaataatcaaatcatctatcacctgagagcacagggggaggaacaatgattgggatataaaccccaggcattcgagctgggagtgggcagcccccttggggtcccctctcattgtataggagctctgttttcactctattaaatcttgcaactgcaccctcttctggtccgtgtttgttctggctggagctgagctttcgcacactgttccaccactgctgaatgccactgtcacagacctgccgctaacttatactcctctggatacggcagggtgtccgctgccctcctgatccagcgaggcatccattgcggctccctatcgggctaaaggctcgccattgttcctacacagctaaatgcccgggttcgtcctaatcaacctgaatactagttgctgggttccacggttctcttccgtgacccacggcttctaatagagttataacactcaccacatgccccaaggttccattccttggaatccgtgaggccaagaaccccaggtcagagaacaaaaagcaccccgccaccatcttgggagcggcctgccaccatcttgggagcttgaagaacaaagacccgcctgtaacattaccacatacacagacatgctctatatttttacgattgaatttctctagtgaatttatcatttctttccttttcctcttatttccctgttgaaaacatactgaaacaaagttacactttgtgattattaacattagaattttcaagctagaaatccatgtatcttccctcacagtctattatctttatgaagtaacagaatgaaaccaccagagataatgctatatttcagtaaataaattatttcaaattacttttatccaaccctcatacaaatggagactgtggatacacttctatccccaaagagaagtaattttcctcaaatgcctatataaaaaatgaattattgttcaatgattagttatatgataaggatgaatatttaatatcactgctttttaactagactaataaaatcgacatttactgtttggttattaagattagacccggttttacaataaaatttcatatattggataacctggagaatctacagaatattttaaacaataattcatttttccagaaaacaaattatttcacttcatgttattttttatagtacatacaaacagaacaaatatgtttgcactaaattatattttttatggtttattttaaacattttagtgataaccttatctttctaatagtcctatcactttctgaaagcatgatcctgaatttcctctggttttatcaatcataaaacatgattttaggcatatagtaatctacccacttaaacaatcaacttctacatttgggtataattactacataatgcatgatgaaatgaattatacacaccttgggtagtgtgtttcctaaagtccgtctgacaatttaaaatttagaaatgcatacaaacatggcatccaaaatccagtctctgtatattacagaggtctatgaagattaaggttttttgctttttcataattttgttaagttataaatttgaggacataacgaatttatgacagttttaaattggcctcaaaacaatctaggatagtcagggtttcaagagcaaattttatcagtggggcatgtttgttaattaatgaattacaaacccaaacaggaagttcctcagagcccaatgttctatctataaaaagggtcattgaaaaactggactgggaatcataatgaaataaaattatttaatttcacattctattcatatctcagaacttatacataaaagagagaaagaggctcaaagaagagacataaacattcaagttatagaaattctgtaagacaagaatgaggtgtattaacctcaggctctaaaataggagaaaattaacattgtgtgtaaatagttacggcattttcagagttagcagaaacttctcagatgttatcactaacgctttgtagatattttattcccttttggaaaaacaagctcataaaaacaatacttcaataaaatatatacgcctagtattgtatgatgtactggtagcacagggaagaaagccatttatttttagagatattcaaaaccctcactgatcaccactgctgcaaaaagtacaagtttagcactataagagttaaagagcagcggaaaatgcccatcttgttatggcaggggagagtattagaaatgaaaccttagttttataaatttcgaaactgtacagacagaatgtgcagtattagctttgccaacactatctgggataataagaatatttacctgatagaataagtcacataaatttagaagaccttaataattttaggagggtactttgaacaagttttctctctcatgctgttttttagaaactgatcctagcaactggttagataaaaatgatcagaaatactgaatgcaatgtgttaaatgattttcaatgtttagaactctgttagaaaaaaataacattttggaaaaagtagatgcaaaagaagtcataatatagaagtaaaatttttttggggtgttacctctgtgaaatctcatacaaacttccaagacacacttaaaaatttggaatacctcctgtatgcattgtgttcctttttcatttttggcaaccatttacatttccaccaatgtttgtggatctaccctctatcagtatttttcttgaacttgtgggtttagtgatgaacaaaaatgataaaatctcttccctataagaacatatataatgactacacatatacataagcctatatgtaactaataaattttaaggaacaatattcagaggtgtgataccatttgaagcaaatggaataaaagaagtaacagtaagattacaaaatttggtgcattaaaaataacaaaattatcttaaatccattgaggaactaaacactattacaaatacatttgagaggcaagggcaacaaaggaaacctccttgatttaaaataaaatcaatactaaaattataatctatttagaaataatcaatagcctatgtattaaaatatatgaattattctcagagtggtggtcaaataaaaatgtaaatatgtaaatgcgtttgttggactataaaaaagaacatatgtattatcaaatattaatttttaaaaatcctacaaatattaaaaattagagcagaagggaataaagacaaaaaataattaaaagaatgtattaaaagcaacattaaagaaaataatgccaatacctgtgtttttgaaagacatataaagtagaaaaaaggcctttgggaaatactaataagaaagaaaataaacaacaggaatgaaaaatgggatagcacacaaatataaaaaacattaaaaacactcattttaacatttctaagagttatacaggtaatgcccacaagctattgacagaagttaacacaaattctctcaattttgtatcaggccgtaacggtaaaatttaggaaaaataggcagctcaaagtaaaactacatgaactatattaaacagggagtatgagagataggccaataaagttatatattatgaacctttccaaaaaagataatgaagtgtccatatattaagataataaaaaataagctcgtatgtatacctactatgtagtcaaatacatcaagaattaaaaaaaaaaatttaaaaagctcaaaatgtaagccagaagaaaatattcaaaagcagtagtaaattgagatctaatacaacttattgaaatgaaaatcaaagatcaaaaattaagaaactgatgaaaaaacaatagcttggctatataaagttaaaatagaaaaagcatctagaatgcaatctcagaaagagcaatggtaactacaaaagaaagtttgcatgacatgaagaaaaaagttagaaaatttgattgatgtctaattggcattttagaataagctaatacaaaagaggtgttttttaaacagataaactgaaaatattccagaattgttgaaagagtggcaatttagaaagctcaactatttgcaagcagaatgaatgaataaataagtaaaccagagtcccaaactattcacaatatagtaaaactatagagcactaaatacaggtgttaaaagcactaactgggtaaaaaaatgcataggaagggcttttaaactgacagttgacttctcatcatcaaggatcaaaaccagatgaccagagaatcagttgagttaatcttcaatgtgttaagtcaaactgcctaccaagcattctctacataataaaaacatttctcaagaataaggatgaaataaaaatattttcatagtaaaatttaaaacattatacagtctgcaaactctaagggaaattctgagacatttatttcagatggaaaaagtattccacatgaaagctctgaaatgtaaaaataatgtgggcaaaaatagtaaataaattagtaataaagcattgactgtataaaataatttaaaaaattaatttatgagaacacaaacaggctagaagtaataaactggacaaaaataccttaatagtttagagtgggatgatctatcaatggttacagctgtttaggcttcatttattaagaaaaggatgaagagtctttaattctttaaataacttgagacattgctaactatgaaagctaaactagccggtctaaattagaccttctaaacaaacaaacaacaaaaagcatgaagaaacaataaaaaataaaaggcatgaaagggataaataaaaagccaagagaaagcaaataaaaaattgacacaactagaaaatcataaagacaaatgtgacaagagttttttttttttttataaataaccctttaaatgctgtatacaagtggtaaatataaagaaaggttgaaactaaaaaagaatggaaattcaagagaaaggatgtcaagcaaagggtaaccaaaagaattgacagttatattaatattaaaactagtagttttcaaggttaaacacattagcctatagatgaagcaggctaccacacaaagagttcagttcagaagaaaaatataaatgtaaatttacatataccttaataaagtaactgcaaagtatgtaagaaaatggaactataaagacaaatgcacaaatccactatcatagttggagatttgaacacacctctcaggtgacagacaacaaaaaattaagtatataagatataaattgaaacaaaaattgcaaacataatctaatagaaaatactacacacaatctaaaatgcattctttccaaacctatgtgaaacattaaaaaagatgacatcactctttatcagtaaaaaagataattcactcaccaaatttcaaagtttattaaacagatgatattctctgaccaaattaaacttagattatcttctcacaatcaatagaagaccaaattatttttcaaagaaatttatgaatcaatgaaataattataacagaatataggaaatgctatgaattgaatgattgtgaaaataaaggaagtcagaagaaatgtataaccttaaatatttatttgagaaaacaaataaagatccaaatacgtgagttgatcatctgataaaagtaagagttgacaaaaaaggtacatcttctccaatccgaaaacagaaagtgggaaagatcaaggtatcactagaggtcaatgaaacaaaacatacaatagtggatgacaaaagccaatctctgaatctttgaaaagaatataataaatgaacatctgaaaccagtgatcgagaaatgttttagataaggcacaaaaagataccaagaatgttaacactaggctgtacatcctaaaacagtcagatgagctcactgttataattctggttcaccgcaagaaccttagcacaaagaaaggactcaacaaacatttggatccatgaataaaattatcttcccacatataaccacctgcctaaaacattctcctcctccttgaattaaattcaccatgtctgcatcataggaggcccaaggccagtaccccctccccatctgcacaccctgtgttcaaaccagtcccagctcctgtcatgttattggcttctgagtatctgtattaatagttgttcctgccagcatatgaagatgaacaaatacacaactgagagagatccagggattttaatccacagatgccagagcttgctgggatgtagtcagaaatcaagctgaactcaggagttcacagtctttcctgtaatgatggttgggaggtgagggaagtcagaggcctggggaagaagacaggggttagctctgggtgggctaagcatgggaatgaggtgtaacataagctctttcctgttcccaccatccatctgctccatgggtagcagagctcagatgcagagagaggtaaaccaggctttccctccttccacacttgcagtccagggacaccaaggcctgagttgggtctgaccttttctaggatctttctccatgctgctgtcctccaggaagtcatggcaaatttacatctccagcaggttgtagaccaacagccttggagaaatacagtatagacagtgggtaaggccaatctcccagcttctgtctccacctgccagcccatgcccacctgttccatctctcatttaccttgaaggacacaccagggtctctccccatggtgtctcctgtactctgctcctggggtcgagtcggctgctggggtttatcatctggaagattctctgcctcagcctcagcctcagggaacaacagcttaccctgcagggtatacagaagctggaggaaggtctgatacctacaaagaggaggtaagtgtgaaggaaaggaatctcagctggaccattttgaatctgcagcccatgctcccgaacttacctctgcagcttgtcccgctcctgttctgcctgctgcttcaggtttccaagtttctgaaacaccctgtcaagctcctgctgagtccctgtcttacgctccctcacctctgcagaaacctccgccagatgctgcagatgcttctcctgccaggagtgagcatgcagacattatgcatcagatgttgaagtcttagaaactccctccaacccctccagcctacacccagctcagggctcaggctcaatgatgaaaagagggactctattcacttcagggtggagtaggggcctagagaaaaggaaagatcagaatgagctgttctagggtgaggcattcttgcggggaaggggcacaaaggtgataacacttatttaacttgctatgtgccaggtactattttaaagtccttgctgtaatgatcatttaatcatcttaataactctctagagtaggtggtattattgccttcattttaaataaagaaacagaaagttaggtgacctgcccaagatcatgcagtggtaagtggtgacactgagattcaagcccatgttggtatttatattatagtgcctcaaaggaggaagcaaaacggttttctagacaggggacacagccgatacaatggcatggtggtgggaagggatattctcctagggggacgaacctacctgttgtagctgccactggttctggactgctctgcgtttctccatggccatttgtttctacagataagcaagggagaaagaccaagagaagtctattttttctggctagaattttgggagattgcaagctggcacaactcagcttgctcactctttccctcttcctttctaactgcccttccctccctgtactcaagacccctgggtgtaccttggcctggagctgctcaaaggcttcccggagttgtgtccgtttcctctgggcttcctccatctgagtcagggccttggtgaggccaattttgatggcctctacgtgctccctgtaggtggccttcagctctttccattgttccttagctgcaattgccttctgtcctgagatgagccaccaggaatgagtacatgagtgagggtggcctgctagcctgcctccctgcaacactgggcctccttcccatcagccaaatgggagacctaactgaaatcctccttccttccccactcaggtcagctgctactacaatcccctgcctactcacggctcgtgtcttcagaagccaaggggtcgagacccttagcagtgtcctcctgagccaggatgttctgcaggaaatccgctacctgaagctggctgcagagcagcttgtctttcttctgagagtcctgctcagagggagggcagagacagggaacatccttacctccttacaggtttccttaagtctgctctctgccagtgctgccctgtatctcagtaagaggagccaggaccagaccctggcttctgaaaggctcgctctcatcttgtacataccaccacaaactcaaccaggatcttggctggcagttctgcctcctcctgcaggcctacaggttccaagatgcctgccacctcagccaggaccctggaggggcaaggaaacacaggaaattgcagtttcttgtggtgctagttctacagttcgtgtgtgtacacaaacaaatgtggatgtgtatatcagtatatatagtattgagagtcttgccttgaccagagtttacacaagggcctgaagggtccacagcctgcaaccaggaatggcgtgcatggagggcacacggtggtaatacgtgccaaaaggaaaatcagcagggctagtggataaggagtttgagaaaagagctgaaattttaaatagggagtgtctcactgaagagaaatcatttgagtcaagatgtgaaggaagccagggagatatgcaaggaaggggaagaatgctgggccttgggatccctcctggcgctgagcaccagccttggggcagagtcttggaatagctgagaaaggactcagggcagagggctggatgcctcggtctactctagggtttttcattattagggactggagcaatctacgaaggggcagggatggggatgagaagtgactgggaatgtgtcgtgttgggacaagaagacagaagtgaaaccgtctcctagagcacatcctgtggattatgtggatgtggggagcggcgaacggtcccccaaaggctgtactcctggagcaggcaacagacacctcaggaacctaagacgggactgcggtgaggatcacttcacggcagggtcgaacctcaacagctgtacagggtcgagggcaccaatcattacacataggggcccacaaggtcctcccaggcccggccccagctgccacttagccgcaaacacttactctagggctgcagcttccgcctctgtctccgctgcctccatctttccaggcgccgagttcagctgccttcccacaatccctaagattactttgaagtcacagtcgacttcgcgccggggcaggcgattggctgcagaggttagtgggcgggcatcaaggaccattgtgcgctctaattggcaggcgcggattcgctcgttggcgggcctcgctgcttggcgcaagcgcggttatggctaggcgcgcacgggctctgcgcctgcgcgctagtccttacgcggtgccagagactataagtgggcttgagctcgaccgcgcgcctgtggaagttctttctctactcgaaaaagggaaagcatttccttgagtttgcgttttaagggaaacttacagcattgacactttatttaaaatattcactactgctgtagaaaaaaaaaaacaaaaccccgaaaaacagtggggctgtttctaagacgctgggaatcagtaaagaatagtgatccgggagatacaggaagcaaatgatctgcgctcaaaaagcgagctgctttcaaagatattagtattttatagatgcgatgcaggagagtgaactcaagcagagcccagccgattgcctgcgttggcaaaatagaacagatattctggggagaccaaggtaggtaatgttctttgcagagtacaggagaaagataactgctgagagagaacttggtattcattcagctgagtactgagcagtatgtgtctcaagaaactagctaaaagatttttaaagataccaggacatggccggtcgcggtggctcacgtctgtaatcccagcactttgtgagtctgaggcaggtgaattacgaggtcaggagtttgagaccagcctggccaacatggtgaaacccccgtctctactaaaagtacaaaaaaaattagttgggcgtggtggtgggcgcttgtaatcccagctattcgggaggctgaggcaggagaattgcttgaaccagggaggctgaggttgcagttagccgaaattgcgccacagcactacagccctggtgacagtgcgagactccgtctcacaaaaaaaaaaaaatacatatatatatatatataaatatatatatatggacattacagagggtcagaaatagtctctatttccactaaccaggctggaaaacttcatagtccgtaggacactggacagagtacacacaaaaaagtcttgatttgatagttgtttactaattatttagtaggcagtaattagtcctagctgatcagtgctgtagtgccatctaactcttaaaagtaagacccaaatggatcaaacttaacaaaccatgacagatgacaagaccaaacttcagcagtatttatagaaatagaaaaatgttcaccaaaggtgcaatttacatatgtcatacaaagaaaaattaccaagcttgcaaaaagaaaaaaaaaaacacataatgaggagaaaaatcaattgctgatcagaactgaagtaatgttagaatcaacaggcaaggacattaaaacagttattgtaactatatcccatatcttcaaaaagatatcagaactataatgaaaaaggtaagtggtgctaaggatgtaaagaaagtggaattctcatgttgatggaaatgtaaactggtgcataggctttgaacgtagggttaccatatgagtcacaatttcattcctagttatatatccaagacaaataaaaacatggggacacaaaagtacacaaacctctatagcagcattattcacaaaagctgaaaggtaaaaacaacccaaaggcccattagctggtgagtgaaaatgcatactttcattcaatgaagtattaatcagtagtaaagagaactttattacatgctaaataatggttactacatgctaaaatatgaaccttgaaaatatactaagtgaaagaagctaattacaaaagaccacataatatattatttcatttatgtgaaatgtctagatttgacaaatctatagcaacagaaagtaaatttatatagtgcttgtccagggctggggattggtgggaatgagaggttgagagagtatggggagggactgcaaatggatatagtgtttcttttaaagggataaataaaatgttctacacttcggttatggtgaaggttgtacaattctatacagaaaaccgctaaatttacactttactgctgtcataaaagctgttaaaaaagttaatcaaagacacaaagcttgtaataaagacctaaatcaaacttgtagaggtgaacactacaatgtgatagatggaattagatggtattaatatagtatgttacacattgcagaatgaaagtgaaacacagctctagagaaactacccaaaatcaatcacaacattaaaaaatgaaaataaagtaacatgaacaaatcaatggtgagctgtgagacaacttctaacagcctaataatatacttgaaagtggagtctcagagaggcaaggggagaggacaagaaaacaagtaataaagaccaaaaaatttgaaatgtgatgaaaaatataaattcatatattcaagaagcttcacaaatctcaaacacaagaaatattaagaaaatgacatcaagttataccataattgcataactcaaaaccattgataaaaaattctaaagtaataaggggtgttggggcacatgttacatagaaacaaagataaggattacgggaaatttcttcttggaacaatgcaagcaagacagtagagtaacatctttcaagtactgtaagaataaaaaaaagtcaaccttgatttctgtttccagcaaacagctttcaaaaatgaagactaactaggctggatgcagtggctcacacctataatcccagcactttggaaggccgaggtgggcagatcacgaggtcaggagatcaagaccatcctggctaacacagtgaaatcccccgtctccactagaaatacaaaaattagccaggcgtggtggcgggcacctgtagtcccagctactcgggaggctgaggcgggagaatggcatgagcctgggaggtggaggttgcagtgagccaagatcgtgccactgcactccagcctgggtgacagagcaagactgtctcaaaaaataaataaaaataaaaaagaaggctaactaaagacattcttaaacacacaaaaatggaaggaaattttcagcataagatcccacatgaaacaagaagttcttcaggcagaatgaaaatggcattagcttcaaatctgaatgtatacaaaggagtgaaatgtggtcctggctacttaggagtctgaggtgggaagatcacttgagcccagttcaaagctgtgatgagttggtcatgccattgcacttcagcctgggtaacaaagtgagaccctatctttaaaggaaaaaaaattgtgatgtgggttttataacatatgtaaaagtaaaatgtagcacaaagtgtgggagagaagaaataaaagtaaatttatatgcttgtatagtttctctgaagttttgttatcagttgaaggtgaactgatgagttaaaactgtgttctagactctctgaagcaatagtgccaacacactttagaagggctaccagtgagtcatttccttgtgtgatttctttctttctagtgcagatagaaattgtgaccaatagaatacaataaaggtgatgggatgtcattctattgattaggttgcttgttaggcagaggggatagcatgccactctcatgcctccatttccatgtatagcagaagcttagcagactgcacaaaaaaaagagggattctccttctggcctggaagaagcatacaaccatgttgtaagttgcctgtggtagttatcacatggcaaggaactctgagtggcctttaggacctgtaaatagacctgagctgatagccaatgaatagatggggccctcagtcaaacagccctgaggggattaagtttctacaaataatcaaataaaaaataacgctactcagttaacatcgtgattgaaaacttgtgagaccttgagcagaatgcaaaaccttgacccagtgaaactgtcttaaaatcttgacttgtagaaactgtgagataataaatgtgtttttttaagattctaaattgtgataatttgttacatagcaatagaaaactattataaacttctaaaacaaagaattgtaggtaacaaatcaataaaggagataaaatataaacaactaatccaaaagaaggcagaaaaagtgaagacgaacaaagaaaaaaatgaagagaataaaaaacaaatagcaaaatgataggtataagcctaagcatatgtgttatcaccgttaaatgtaaataccttaaatataccattaaaagggagagattattagattggataccacagcaaaattacgttaagtacactaaatataaagaaataaaaggatggaaaaataccatgctaatattaatcagatgaaagctgaagtggctattttagggcatatatatacacacacacacacacacacacacacacacacacacacacacacatatatatgtatatctatatatatatatctatatatatatagatatatagatatacatatatatatttgggcaaaaggctgtcaccagaaataagaaagtgatattatcatgataaaggggtcaattaatcatgtgaacttaatcataaatgtttttggacacctaatatgagatcatcaaaatacatgaatcaaaaactgaactgcaaggagaaatagataaatccatagtcattgttgagatttcaataagccacttacaataatttatagaacactgaacctaacagcagaatagtcatgctttcccagtgtatacccaatagtcaagtccatattatgggtcataaaattagcctgaacaattataaatgaatagtacaatgcaaaatatatagtttttttgtttgtaaacgatctaaatagcctcctacatgcattgaatgtgatgttgtatgctaatgttgcagtctttttctttgacttaattaactcctaacatctttagatttctgctcaaatttttcagacatgatctagattattgttcagatttttcagacatgatcaaaccttccttcacctatatgcctatatcaggcctccttactataggctcacaaagctctacagactttttatctagtcacagttgcattttacatctgcttgtagaattatttgagtgatatctcttcttttctaataagcttattgaggataaatgctattttttgttaatagttgatactaataatttgttctatgcacataagggacaattcatgcaaggctgcagtaggtcattttaagcatattggttttatataaacatagtagaaatctattgaaagtttcttcataattagatggcaagtcagattttagtattgcaaagttaagcctcaattatgggtggaaaaataaaaggttgaaaaatgtgattattccagtaggcttagtaaaaggtgaaaacatttttggattctataagtaacttggcactaaagatacaaatagctcgatatatttaggtgaaatacttcataggttttatcatttgttggatatgttggagttactaaacgatgtataaaatatgttacttcagtttctgatggtgcaactggatgaactgtgatacaatttatttaaatagtgattcctggaagataattctatttgacaaatgacagaggaagattttcaacttgattttgttgacctacctattagaggcattttagctattcatgtatatatttttaaaagacatttgaatgtgtcttgaatggataaggaggtttagggcttggaaaaatgtgagaactggaaatatatatttgatcaacataaatatgtaggcaattgaaactgtggaggtcaatggcattccgtatgctgactatagaatgaacaagaaaagaatgctggaatcaatatagttgagtaactgacatattgtggatttgtagaaaaaagatgagtttctagtaacagagaagtacctacagtgacagaagcattaaaggaaataaattgagatgcgtaatacagaaaattcttaggagaattttcagcaatttttcattagccaatgttttaacgctctccattgcaatttgtattgtatgcatacttccaatttaatgaaaaatgcttttcctatgcattccataaagaatcttcttgcttgactagtaagagttcattctgcttgatgtgtctatgttttaacactgtctacatattctacatttatgttacagtagagataataaatgacacttgctaaaatgcacattttgattaaagtggcagggattggctttatgtgtgagagtttagatacctttgatctatttatcacaaattcctatgaagatactgccttttgaataagatattttccaaatgtatcaatgacatcactgttaacatccaaatttaaatagtgtttgattaaactgaagaccaaaccgttcaaggataaaacaacaaattgcaagtcaaaatgacatgctacaaggtgacgttggaaaataggactttaaacatcatactgcataaatttgccaactctatttccccctctacttggctctgattgggagagatctggcctaaaattctagtgaaaataactgtagatcaattaaaaggtataagtctatgtcttacttttttctgtgttgtccaatacgcagcttttattgtttagcacatatgaaatggctctgaaaatagtagttgcattaacacttaaatagaatatcaactatattattagaatatatgaagtgagcatggaggcaaattcatgtgagatttatagagcattaagcaaatataagtaagcagataaaacttatctttgcatttgtctataggcagaacacctccagtacttaataaaacatcaaaactgacatcatacttttggaatctatttctattgcatagaaacttctgtttgctgtgtttatctctctcagcattgttttaggaattgaacctatatttccagatcatcacttccttgaggcaagatcatctaaatgggtcatggaaacccaataaataaaaaagattatatataaatatgtatgtatcttaatatatacatatggtccctgtctttccctctctgtacctgtctctacatatattttctcatgtatgtgaatatcttacattgtaaacattatctaaaaagtaatatcttgaaattcacttaattttctccttgaattttaacactagccttttttctcaatagaatctctgattgtttgctttctgtgtcacttttattcaccggtagctaaaatgtaattttattgtgatatttattaacttagaggcttaagcaataatggcttaaataaagcacatgtgctataatgatttcaaaggatgcctaaaaatgcacctgtagaaatcagttcactttgtatatgtatagcaaaacttgttgtacaccttaaatatatacagtaaaatattccatgtactatgtgttacaattgtcaaaaatatttcttctaccttcctaaatgtaggaatatttctacatttatatcacatccattaactgatggatgtttttccaatatttcttaaatattctccaagcagtcttaaaacttacataatttaacctgctgaattttttttaaaaagatacttttggtaatagtaacttttaaaaaacatttttccataactagcattacaaaatgataaaaattttatttaaaaaacaaactggggctgggtgcagtggctcacgcctgtaatcccagcactttgggaggccgaggtgggcggatcacgaggtcaggagattgagaccattctggtgaacacggtgaaaccccatctctactaaaaatacaaaacaattagccagacgtggtggcaggcgcctgtagtcccagctacctgggaggctgaggcaggagaagggcatgaacccagggggcagaacttgcagtgagcggagatcgcaccactgcactccagcctgggcgacagagcaagactccgtctaaaaaaacaaacaaaacaaacttgatgaatatttctttgttttgggtgtttgaatgcattaaagcaagttgtatattcgatcaaaacctctacacagtaaacttatatggcagacaataaaacaattaaagtgttcattaggggctcagactcttgatgagcaaaatacttttgctttaataaaccaatgaatatttcttctgattttattgtgtgttttcagtgttgctttgggaataagttttacctacattttaaaacagttttataaaagtagaaattacatgcctagaatgtattaattataagtataaaattcagtgatttattacattgatagaattttgcaatcagttttaagacatttcattaaccctggagagatccattttgtctctttgcagtgaacttcagttcctactcccaggtccagaaaaacaatgttacaatttttgtctctgtagactagcctcttctgcacattcaggaagtacacgatatttaggtttttgcatctttcttctttcccttcgcacagtgtttctgaggatcatctatgttgtagtatacatcaataatttgttcctgtctattgatgaatatattccattatgtgggtataccagatacagtttacttgttcaccagttgatagaaattgtattgttctagttattgacatttataaataatgctgctatgaactttcccttaaaagtttttgtgtgggctaggagcagtgactgatgactgtaatcccagatctttgggaggctgagaccagaggatcacttgaggccagtagttcaagacaagcctgagcaacatagcaagacactgtctttacaaaaaatacaacacttagctgtgtttgctggcatgcacctgtagtccaagctacttgggaggctgatgcaggaggtttgcttgagcccagaaattcaaggttgcagtgaccccgattgtgtgaggtggaaattaaagaaagaaaggaaaatgaaaaagagaaagaataagttttctgtattaagctgactcatctgcaaggcagtgacaggcaaaagctagacctacgcaaaagtcctgataacattatctaagaagccagagctcaaaggaatgtgctttggagactctcccagcactcccttaacattaggagaagaaaaacaaattttcctttctctaatgatatgagtaaatctatgagtttatgtattcctattctctgtaactagtaacttcaagtattctattttatgtaagtggcagagaaggccataggaagcctgagcaggcctgaactacagccacctaggcgccatagcgaaagttatgagataagcctgtacaagggacttgagtaaaaactagataacagccatctaggccacatagcgagatgtcatatgtaatcctgagttatgcacctgacacaatttgattaactgtctttgttctgcttctgtacacttctttcatgccactacgcttcacagcactgtaagctagcttcaaactagccaaccccctttttaaagtgtgtataaaagccaagacttgtctttgttcttagtccagtttttagtatgctaggtctgagtgcactcactaaagatcctcctgtattcaccccgtagtctctctagtccttctgattcctgcaacagtgcactgccctccagcctgggtgacagagcaagtgcctgtctgaaaaagaaaaaaaaaaaaagtgaacacatgttgacatttcccttgagtagataactagaaatggaatagctgaatcacaagataaatatatgttttgacttttcaaggaagtgccaaggtattttctaaagtggtgctaccattttacattcccacctactatatatgagggtttcaatttgttcacatctttacgtggtatgttcagtaattttcattgtaaacgttctagtgggt

SEQ ID NO: 482 - DNA, 93249 bp, Homo sapiens
tattcattttgtctttctttctttttatgtgatggattatgtttcctgatttgtatatattaaaccaactttgcatcctggggatgaagccaaattgattatggtagataagatttgatgtgttgctggattcagtctgccagtattttattaaggatttttcatcgatgttcatcagggatattggcctgaagttttcttttttgttgtatttctgccaagttttgatatcaggatgatgctggcttcctaaaatgagttagggaggagtctctcctttttgattgtttggaattgcttaagtagacaaggtaccacctcttctttatacctctggtagaatatagctgtgaatccatctgttcctgggctttattttcgttggtaggctatttattactgcctgaatttcagaactcattattggtctattcagggtttcaatttcttcgtaggttcagtcttgggagagtgtatgcttccagaaatttatccatttcttttagatgttctagtttatgtgcatagatgtgtttatagtattctctgatggttgtttgtatttctgtggggtcagtggtaatattccccttatcatttcttattgtgtctatttgattcttctctcttttcttctttattagtctagctagcagtctatctattttattatttttttttttcaaaaagccaactccaggattcatttattaaaaacaaggggtttttgtgtttctatatccttcagttccactatgatcttggctatttcttgtcttctgctagctctggggtttgtttgctcttggctctctagttcctttagttgtgatgttaggttactgatttcagatctttctagctttttgatgaaggcatttagtgctataaatttccctcttaacactgctttagctgcatcccagagattctggtatgttttctctttattcttattagtttcaaagaacatcttgattttggccttaatttcattatttactcaggagtcattcagaagcaggttggatgttcaattttcatgcagttgtgtggttttgagtgaatttcttaatattgagttctaatttgattgtgctactgtctgagagactattataatttcagttcttttgcatttgctgactggtgttttacttcagattatgtaattaattttggcataagtcacatgtggcactgagaagaatgtatattctgttgttttgggtagagatttctgtaagtgtctatcaggtccacttgatccagagctgagtttaagtcctgaatatctttgttaattttctgtctcaatgatctgtctaatattgtcagcggggtgttaaagtctcccactattattgtgtgggagtctaaatatctttgtaggtctccaagatcttgctttatgaatctgggtgctcctgtgttgtttgaatatatatttaaaatagttagctcttcttgttgaattcaatcctttaccattaggtaatgcccttgtttgtctttttttatctttgttggtttaaagtctgttttgtcagaaactaagattgcaactcctgcttttttctgttttccacttgtttggtaaattttcctccaaccctttattttgagcctatatgtgtctttgaatgtgagatggatcttttgaagacagcataccaaaggttcttgactctttatccagcttgccattctgcgttttttaattgggacatttagcccatttacatttaaggttaatattgttatgtgtaaatttggttctgtcatcatgatgctagctggttattttgcagacttgtttatgtggttgcttcatagtgtcactggtctgtgtgcttacatgtgtttttgtagtggctcgtaacagtttttactttccatatttagtgcttccttcagtaactcttgcaagccaggcctggtggtgacacatttcttcagcatttgcttgtctgaaaaggatcttatttctcctacacttatgaagcttagttgggttggatatgaaattctgggttggaaattcttttcttgaagaatgttgaacattggcccccactctcttctggcttgtagggtttctgctgaaaagtctgctgttagcccaaaaggcttccatttgtcagtgacctggcctttctctcttggctgcccctaacattttttcttcatttcaaccttggagaatctgagggttatgtgccttggggttgatcttctcatggactatcttactggggttctctggatttcctgaatttgaatgttggcctgtctttctaggttggggaagttctcctggatgatatcctgaggtatgttttccaaattggttttgttctccccatctctttcatgtaccctagtcagttgtaggtgttgtctttttacattatgccgtatttctcagagattttatttcttcctttttattcttttctgcatgttttatttcagaaagatagtcttcaagctctgaggttttctcctctgcttggtctaatctgctattgatatttgtgattgcattgtgaagttcttgtgttgtgtttttcagctccatgcagtcagttatgctcttctctaaactggctattctggttatcagttcctgtattgttttattatgattgttaacatctttgtattgggttagaacatgctcctttagctcaggaaagtttattattacccactttctgaagcctacttttgtcagttcagccatctcagcctcagcacagttctgtacccttgctggagaggtgttgtggccatttggaggagaagagacactctggctttttcagtttttagtgattttgcattcactttttctcatttttgtgggcttatctatctttgatctctgtggtagctgacctttgaatggggtttttgtggggtcctttttgtcaatgttattattgctttttgtttgtttttaacagtcaggccactcttccataggactgctgcagtttgctgggggtctgctccagactctagttgccttggtccctcctgtacctggaggtatcaccagtgaagcctctgaaatagcaaagacagcagcctgcggactgcagttgcttctaaccagtcatcttggccaaccattactgtatttttttcagttttagagaggtctatgcctttatttcagacttagccatatatctcaacctatatttttatttagattgcagggaaaatgctaacaaatgattttgaataagtgtgaaataatcagtagagatagtaaaaaaatataaattaagggtactgcataatcaaatacatgattctgacaaagtcaacccttacaagaattctgtcatcacaaagcatatttccatggtctctgggaccaccttcctctctcagaactcactgcttcaggtttgcagggctctaatagtgtgttccaaagatattgaaatattggaaactatagttttccaatacttaaattgttcatgatctttcaaaacagacaactttggacttcagtgacgtcaggtcctattttttgtttttttggcatactaaaaatttttaattattttaaaaacagaaaagcttagaaactaagagaaaagagtaaatagtaaacaaatccatgttatttccttccacttcagatttattagtgattggatttgaaaattatttactacgatgtaggaggaaagtcagacatatttggaaggctgcttttaaaacatagaaaactatataaggaggcaaaatgggagaatatttgttaagtcatcccaacttgtcaatgattgttcagcataaacaaacaaaaaataaataagcttagatttggccactttcctgctcttgggcattaaatgtcagtcatttttcactgagttgtagtcaacaatatgtaagtcacaccagctgcatatatctagccatggcacttattttcagagtctaattagtcaaattctgatggatttcctgagtgctatgggtaacacagaaactcaggtaagaaagataggctatgtgcatgcttgtttgtttgtttgcttcttttaattggcatggtatggcaaaacatcaaataaactcacccataattttagttaaatgctttttaccatacctctttctaacataaatctgcatgttctgcttagtactgcaaataaaatcacccataattctagttaaaagctttttagtgtacatcctcctactacatgttacttaatattctttagtataattaaaatctaattccctttgaaaattttggactactttactacttccttgtccattttgttatccaaggtgaaataatattagaaaattattttccaaaatctcttcctccaaaaggagagaaaaagttatttgattgttgaggatgcaaaaaggctctttctggttctgcttccctgcagccctcagtttacccagcccctctaatggaaacatgcttgggtaggcattcactattctctacacatcccaatgcaggcagcagtcccaaaattaaagctaaggaactacattaagaaatatagtttagacacagatttaaaccacatcactcaatgcagctttttttcttttttagttgaagctggtattttaacctacattatatacaatttgtgtcatgttctcaattgatttggaacacagggggctaagaaggggtgtttgtaattattacccacaaaccacaatagaaattgaaaaaaagtaatcccataggcatataacttaaaaatcacaggataaaatcatatgtgtaccacccttgcaaagaacaggcatcacatgtttttatttatttatttggatagaactgcattgttcaatatactaacctctagccacaagtggctattgagtatttcaaacatgaatgctacgaagtgagatgtgctgacagtgtaacacacaccagattataaaaacttggttaataaaaagtaaaatagctcagtaatttttatattggttacatgctgaaatggcaatattttagatatgtcagattaaataaaatctattattaaaattaattttacctgtttctttttttcttctatattgtagctgctagaaaattaaaaattcaaaatgtagcttacattttatttccattagacagcctgaattacaacaatggagaaaatgcaatttccttcaatttgtgtataatgtcaatatctgggaggtcttgagcaaatgtaattaacataaacttaagagggcaaaacaaagacaatcataaccagtggcaccattatgcaataacgataactgattcctacattgaagtttctgtttggggtcaagttattactttatttgcactgtattctatgtgactatacacagagtttccccaaaagtttcagtctcaaaaaacaaacaaaaaaagccaggaacctatgttcttctttgttgttgttgaggctcaagtaattaaaccatattcgattatttactgtaaaaataaaaataagtttgtccattataaagggcaaatagagcaatttatctcattctttttccagaggatttccttggaaacagtatatttgaggtaaattcttcaaggattaagcctaatctttggtttttatagtgttgggatacccctaaagtggtgggcaaaatactgtgtagatatatataagaatttacctcggccgggcctggtggctcacgcctgtaatcccagcactttgggaggcaaaggtgggcggatcatgagatcaggagatcaagaccattctggccaacatggtgaaacctggtcgctactaaaaatacaaaaattagctaggtgcggtggtgcatgcctgtaatcccagctactgggaacgctgaggcaggacaatcacttgaacccaggagttagagggtgcagtgagctgagatcgggccattgcactccagcctggcgaaagagttagaccccgtaaaaaaaaaaaaaaaagagagagagagagaaagagagaaaagaaaaaacaatttatcttttaaagcagctttggagttccccatgagatacagggaacaggaagtgtagcttttggtttatcaagggaatatgagaattattttctctttcttcttctttgctatataaaatgtgtgggattttgtcctaaattcataatactcccttataatgtaaatgttaatgttcacacagtaatatgttgtgtttttgctctctcttctattgatatgaaggaatatttttattgatgggattgttttaattcctaacattatttaacctataatctgagtcagagtacatacaaatcccgactaaatataaacgctaaaccagcactaaggaattatgatgtaatgagacgaagctaacgtggttaccttttgaaataatgaaaggatgttccaaaagctgtcatcaccatagttgctggtggtacattatagaaaaacctgtgccaagacacattcaatgttaaacaactgaagctggaaattattcaggattttattaaaaccagtaatttattttaaagttaagcattagtacagagagagctgaagttacttacttaaggacacattctatgtaaagtagcaaagttggaactagaatccaggggtcaaagtcttgtaaagtgctatagtgatttttttttctttgattcagtcctactttgttttaacttgtctcatctccctggtgataatcaataaattaaaacctgggctttgtcccaacatggatgcttaatacagatgggccatgaagtaaaaatgattgttgttccccaggtatggtcagcaatcaccactaggcaacacaaataacattttcacctgccagttcacattgcactactattcttctaaaataacatttctaaattccttttgtgctctttctgcattgatagattattctttttaattaacttcctttatgacaacctttaaagatactattactggatgaataaaaatctacaattattttgtctccttctggactttgtctcattatttaagtatttttagcttgactcttttcctgcttctcctaactctctcacctcaacaacactcttggttaaaaagaagaaaatagcttcctcagtaaaatttcttagaaaattgagacagaattgaccattccctgtattccaatcttgtgggactgtaatctattccaagggaatgttcagagcattataaccaagtggcttagaataaaaatcacattacatttggaaataatggacattatttacaaatatagttttataaatattctcaagtgacccttaatgaaaagatacaaagtaggatatatttattcaaaaatgtgggattctccagctcaaagaaactgtctgacattctttgatattcaagatatatcattcgtaggccactaacttcattggaattcaccacaaaatgtttgagaagatagaaacgattattttaaaaaaggataggggatatattttcaacatacttggagactacaaaaaaaattgaatagccatatagatatatttctcccaggacacaatctctacctttttgaaagtattaaaggaagatgtctactctgtaagttaaaatttctaagctgcatcataagccaactggccctatgttaggtcagttttaaatatctattttcatgagtagaagcctctctattcctgggatccaaaaggacctaaaggaattggtgtccacatgcaaatgttattacctttttatccaccttttgtagcaagaacctatggtcgtattagtgagcaaaaaataacctgaaactggaacttatatttaaaagggaagcagagcataacagttagaaaatgtgtagcctggccatgtcgtagtaaagaaaaaaaccattttcaggggagttattcaagcctgctgcagaaatttgcataaatattaataaaaagcagctgaacattaacagccaagacaatgggaaaaatctctgaaggcctttcagagaccttcacagcagcccttcccatcacaggcctggaggcctaggaaagaagaataattgtgtgggctaggcccaggacccctctgccctagacaactttgggacactgcttcctgtgtcccagccactccagctctagccgtggctaaaaaggacacagatgcacctcaagatcctggtccagagggtgcaaatggaaagccttggcagtttccacattgtgttaatcctgcaggtgcacagaaggcaagagctgaggcttggaaggctccacctagatttcataggatgtgtggaaatgactggtgtccaggcagaagtctactgcagaggaaaagccctcacagggaacctctactagggcagtgcagagggaaaatgtggggatggagcccccacccaaagtccctaccagggaactgcctggagctatgtggagaaggccaccatcctcccgacccccgaatggtagatccaccaacggcttgtgccatggtcttagaaaagccacaggcactcaacgccagcctgtgaaaggaattgcaggggttacaccaatgggatatgcacaggggcagagcttcccaatgccttcggagcccacctcttgcatcagtgttacctggatgtgagacaaggagccaaaggagattattttggagctttaagatttaatgactgccctgctgggttttgaacttgcattgggactgaagcccctttgttgtggccgacttctcctttttggaacaggagtatttagccaacggctgtacctccattgcatcttggaagtaactaactttttttttattttacagtctcacaggtagaaggcatttgccttgtcacagatgagactttggactgtggacttttgagttaatgatgacatgagtcaatgcttgggggactgttgagaaaggattattgtatcctacaatatgagtagggcatgagttttgggaggggccaagggtagaacaacatggtttggatatctgtccttgcccaaatttcatgacaaattataatcaccaatgttggagaaaaggcctggtgcgaggtgaatggaccatgagggtggacttcccccttgctgttctaatgataatgagttctcacaagatctggttgttttaaagtgtgttgcacctccctgtgctctcacttcctcctgttctagccctaagatgtgcctgcttcccctttaccttctgtcttgattgtgagtttcctgagaccttcccaggcatgcttccagtacagccttcagagctgtgagccaattaaacctcttttctttataaattacccagtctctggtagtcctttatagcaatgcaagaataaattaatacaccatgtgttcagcccaaactcaggaagtttaatcgctaaaagacaaagagagaaaattagtatcaacagaaaataggatataataatattgccaatctactattgtgtagcatgagtacagttggaatgataacgatggagagacaaaagttagaaatataaagaagggagtaggaaggaagggagggagggaaggagggagggagggaggggaggatggagggaataaataaagtgtatgtttttcagatattacctgaaattttttctattgatagctcagagtgagaacattgattacggattaaactgtaaacaacaacaaaaacctatgcaagaaatataaattgtctgggagctgacacttgggtaaggtttggaagaatcatgggaacatcaacatagctataatggaagaaagatatctcaagtagtgctagggaatttatgcttaacatggaatgtattaagaatgacataagaaattgtattcttcttaagagagtaaatttaataagattttattaagaagattccatagcaagcaaatgtggaattgatttggagaggacaagaatagaatcagcaagtaaggtgagcagtctcatgatgagcaatgaaaataaggcaaggagagaggaatggaaaagaagggattatacaaggaaagcttctaaggaggaattggcaacagctgatagttaccagggtgtggataccacgtattttgaaattaaagacctactgggcacataaaggaattgggtctaaggaagagtggacagaaacccacaatcctaggagattatgagtgccaaaaaaatgtttctttcctgaaattttactaaggaaaattgcaatcagaaacttttactttaatggcactttctcctaactggggaatattatcttagtttccaatgacaagactgagtctgagaaccactgaaattttcttaaagaagcggcttgcttctttaataataatagcatcttcattgacattcaggcttttataagcccaaaaataatgataataaaatgtggttgttctttaaaaaaagtaatcaaatatttcaaattccaagtgaattaaaatataaagttaacctcttaaatcattcagtgagaattttatttcagtgttataaactgagagcattaactaaaagttaaaataaaacaagtcatttatttataataaaatattggtttttgtttgagaagaaaagattctaaatatattctggatgttaaataaagtggctctgtcataaaaatgcatcaataagttaaaagttaattattgtattttttaaaaatatacaattacagcatttttaatccttgaagctttaggcacttcaccacttttagaattaaaggtaattaggaagctaaaattgaattgctacattaatagaggttacattatttttcaaaggagaattcttagatattttactgatattgttgcttttgaataacgtaccagcctaaatttcttttactctgagatattttcaagccaactaatgacttcaatttgtcttggatttttaactatttgatgaccaaaaaaagaaagaaatacatttagaaataaagagaaagaaaagaaggaaaaataaagaaaaaaaaatcaagttatttggataatttcaaatcaaagggagatgaaaaaataaagtcaggtaaacaactcactagaagaagaaacgccaagacataagacatgggaaaggcaaacgtgaaaaaggcaatgaattcactttactggaaacagtgcttacattaacgtagaaatgtaaaatagtgagacccccaggtatcttctaccacttgtctctcagaatgctggctgtcagagaaagtgggccaaagggcggaaaacaaacacagagattaaaatttggtagtcagccaaaaagcagctgagtcttatctaattactataaagtctgacattcaaaagtcaaactctcatgtattaatagaacttctagtcatctctgtatgcttcattttaaatgggaatgaacattccacggtcaccatggttcagagtaatgagcaagaactgcacacatagacccaagaacacttgtaaataaaagaagatggcatggatcaagagaatatccatgatgatgtcagttgtgttagccagtaaacagggtaaatcagcttgccttgctgcagtagtaaagaggggcctacacatgctttttataataaaataataaaattgccatgtttgttcacgttcagatcacatgcacaattctgttacagagtttgaaaaacaaacatttgaatagaaacttagtaaatcattaaagaagtaaaaataaagcaactttttaaccctggaagagaaaaattttgtcaaaattataaaatacaattatagctccctacataccctgctcagatgtatatgtatgcaaagttacaataagctaaacataattcattgaatcaagttagattatactatattgactcctaaggagtggggagtaggagttaaaaatgtggtggtgttgaagctctgagagctaaatctgcacatttcccagagccaatagtgtctttaatactaaaaatttaacaggtataatctaaattttaaaactaaaaatagcattctaagtgaataattcagaagaatggagttaaagtcaagaagaaacattttaaagagcaaaaaattgttttctaagggaattgaaaatctagagagttcagaggcaggaggatggaagagagaactgctagtttttactataagctttacagcctcatttgactcttttaacatgtatatgtattttttcaatttttaaaaataatgactatagacttctggtttccagtgcagcatgcaaggagcttacaggtcatcattccatccaagcaacaaggaaagaactgaacaaactgaaaaaaacaactcttcttagatccgtgagagaagtgaggtcatagggcaagctgctgtgccccaaactggagaaacagtaaggcacgtacaagaatcacaactgattggagtggaaagccttaagcagaaacctctgtgggaacccagcactgggaaagaaaaacctaacctgtaactcacaaattgctagaagctcaggcttgacaagtctgagagttaaaaaccacagggagggccagtcctagtgggcagggcacacccacacttttgtgagctttaccttcatgagctctaccaggttcttatagttgaagatgggagaaaaatctcctcctgtttctggcaggaaaagggcagatgtatgtgtgtttaaatattccagaaccttctgctcttcttaataagtcctgccctcaaaagaaactattttaccagagcatagcctattggagtattatcagagtctaacccactgtgagctgagacaggggacacccaactctggcccactctaaccatcctgtcccacctaaggaggagaaaaactcagaagcactttgtggagtttcacagcccaggggcacagactgagacctaatctcaggtccagagaacactttcccttttaccaccacaccactaaaggcctgtttgctgaagttccttttatccagtacatcatgcccagctttccacaaaaattacaatgagtatcaaaagacaagaagtaatgaatagattactttgaccaaaatagctggacacagcctttttttcaggcacagttttacagctcacaacatttatctaataatccagcaatgcgagggtaaagtaaaacaacacatctggtcaatttggtatttattgcattgtaaaaaaagatagcaactgtttaaccagcaatgtaacagggaattaaccaagacagtgaattaccaagtcattttcacttgttcatgatatttgacccaatgtcagataaatatttgtctctagtcaatattacataattgcagtgtatgagggaaaaatcacagagcaatatcatctacttaaaatctttaatcaaagatatttaaaagtagcaattctcttgccaaatttccacaaggaatacagcgtatgaggaacatgtttatttttcacagaaaaaagatttaagatttgaaaaatgttaataagcacaactgtttgccacaatcctatttaagtattagaaactgaaatccaaacatagcaaaagggatactttggaatatgaactaccaaaaaggattaatattttctccccagccattttcagactcacaatgttataagtcatccaggccttggccaggttagatgtgtgttagtatgaatcatttacagctccaaaacacaggttatctctaacttttcccatttccatctttaagacattgtgccttgcaaatctggaattaattatataaaagactgtcaagctacctcatgtccttctggaaatgtgagtgacatgtttttctcccttctgaaacaaatgagaacagtgtacaccatcttcatagggcattttgctccttgtaaaacggctttcaatcgaatattctttttatagtgattgattttaaaaaatcttactatcaccagctcaatctaaagtcccagctacacgtttctttcatacaggaatggaagtcttgtattcagtggagcttttagcagcattcttggaacttaataaatattaaataccataatttcccagagattaaagtcaccatgattttagatttgacaatatatatgtttattactaagcaaaaaaaaatttgaaaaataactgttttttaatcaacaattacaacccaaatagccaaatagctaacatttaccgagcttactatgtaacattaagtgctttatttacactatttcattttctcacagccctgaatgtttctagtaatactgccattctaaaaatgaggaaaatgcaacttcaatatcgtctaactagtaagaggctgaattagaattcaaacacagtccttctaactctatagcctaggttattttttaataaattttattttattgtggtaagcacactaaacctaagaactaccctcttaacaaaattttatatatacaatatagttttgttaactatagggataatgttgtatagcagatatctagaacttatcaatcttacatcttggataattgagactttatgcccaagcttttagccattatactacaggatatttagaaagatacaggcaattacaaaaataaaatggaaatcattcttaaatttgtcccctaacaataaccagtgacatgttggtggatttttcttctcatctttatttgtgcttctgtatatctctgaaaattggaatcaaactaatagagttttaacattattcttttcatttcaaaaactacaatatttcccatgtcattaaatggcctttgaaaatagaatttaaaagctacaaaagaaaaacatttttacttaaatgatgcaaagaattgtcacaattctttatgtcactcagcctgtgtagatttggtcaaaatgaccacatttgtcttcatttcagggacttttaatttcctcctaagttatcaaaatatatcagtggagttgcattttttctttgcattccatatgcagcctttcatctgaagcagttccaaagcaagatgaaagaatttaactcaattgagggatctaacatcacctacagcctaatgggtagcccttccttgtcaaaacaagccagctggagactaactagagaacttcactagggattacctaagtggaaaatggaatttttcttcaaatgtagtgagatttttaaattcattcttccagctttaaaagtacaaaaagttctcactttacattgttgataggctcatgaaaactgagacattaagtgaaaggatagaatatcctcttgtttaatgtcatctagttacaacgttgatgagaagaaaaaattgcagattccaataacctatctgtgaaattaagtgaagaccatttgattaacttttgtccactcataatccacatgaaaaggtagaacactggagaccatggtagatacaggaccagagaagagaaaagttgcttcatttaacaccaaagaagttttgattgacatgcttttgtccagaaaaaatgaagactagaggctctctaaatctaagagttctttttgaacacttaacgttttattcatttccttgctcaatatatcctccctggggctacttagatctctatgggaatggtgtaaagaatacagtcaaaatcatgaatttattttgattttctgtttactcttttattccactgtgcagaagaaaaatggtactttatatggatttcagtaaaaataatccattaacagatcactggaggaaagaaagctaaattatgctgcctgtatgtagaatactatggcagttggttaagaatatccatggggcattcctaaaaatgcacatgaaacaggctggaggtggggagttttaaagactaagcagtgagatggggaaaaccaatatgctggatgttcaaacgtacacaactgggcaacctaatttaatatatagatttagttaaaacccacatcagtttgttgtgtagtgtgaagtataagcaaacttcagtaaaagcaatacatcctctccatgttggcatattcataggtataataaaacaaattgccaggaaggagaagacaattactttacattcttacaaaatactatggatataagttgaattagtgttctgtttctctgattgtccctgagatggctgtgttttactacaatttgctttcctttcccctatcaaatattcaaatgggaatggccgtctttttacatgagcctacctccctggctgtcaccttggactcagtgaatagattctatctattcatgactcaatgaataaactctgtctattaatgactacagccagtcagtcacagaactcttcttctggccattgtttagtccacctctgtgaagcacacaaaccattattggcagttggtgtttgttctcaatattgtattatttgagctgttgatagagaattgttttctttctggtgatgaagcttttaagaattgaactgttggccgggcgcagtggctcacgcctgtaatcccagcactttgggaggccgagacgggcggatcacgaggtcaggagatcgagaccatcttggctaacacggtgaaaccccgtctctactaaaaatacaaaaattagccgggcatggtggcgcacgcctgtagtcccagctacacgggaggctgaggcaggagaatggcgtgaacccgggagacggagcttgcagtgagtcgagatcgcgccactgcactccagcctgggcgacagagcgaaactccctctcaaaaaaaaaaaaaaaaaaaaaaaagaattgaactgttagtagccatacttccaggtactttaagataccaatcagaaataacgaggtcaacatacagaaagaagcagagataaagatggaaagaagtccgacttttagagaactattgaaaatccaatgaatatattttaacttgtttgaaagggttttttgtgaattttgtgatgaaataagatactttcttgtaatagaaataaatctgagtctaaatccagagcatttagttgtgtttgacaatatggcattgtctgttttgggtggggggaatttaagaaaataaagtctaattttctgctttttctgatttttcttttcatttagttaaaatttatactagaagaatataatttccaccatatataagatcatgagatcatttcagtaattagctattggcatgtgttgaaatatatacttttgataatctgtaatttggaattttggcttatgacagttaaggaataaacagtgagatagggaaaagcaattagcttttcatcttatttatggtaagaactgcattcctctagaaaagtttataaaatttatctatgaatctagaacggctctaaagcctattaaaattttaaagagaaaaacctatgaggattctcccttgtagtcactaacagtctgattaagttattcggattgagtttatttgatccacagacatcatttattaacccaggaaagtattgtttctatgaaggaagtacattagtgtgatgtaggtaactatcatgtagcagattcaaatctcatagaaattgtagctagaactggccactatataccagatcgactgaccttcagttgtttcctttgaaatttcaacaatcagtgggagataaaatcagtgaaaaaatagttgacaggcctgtgttgcatactgctgccttagggatacaattttttccctgaaattactttgggtatatattcagatttagtccactagtataacatgatagaaatgttcccatagattttaaacgggtgctgggagagaactcagaaaaaaaaaaaacttaaagaattttctatctggaagaaaactatttttgatttaaaaaacagtgaaatatattataatttatttttaaaaatctaagttgcaaaaatgtcataagtacaagtctttgatctccatggtgaagttctacactaaaaattatgtcaaaattcctgtctttttatatgctaagcagtctatatgaccttacaacactatactgaaccctgagttttatgcactgaatgtatatttttggggggagaatttaaaagcgaagactagaaatatgaaggaaaaagataatctaatgataattataatttatttgttaattaaaaaatatgtgctgaccaaaaaaaaagaacaagatatatttaggtaaaatatcatgtgagaaacaatccaagtatgggaattacaggaatatattttagtctaacttttattcttaaatagctgtgtgatctcgggcaaaacaatgaactgtggccttcattttcttatcagatgtgatttccaatatgtggtatttgagatcacagaggatcaaagatgttataaattcatgatgtttgtggcaggtgagagaagggagaatttatagtgaagagagcataggttaactatgaagggcttccatggagaggtattttagaaagcatggagtagtaggaaagagggattttgaagatgataaaaaaggactacatgcaaagaaatcctaaataattagacattcagccaaaaatgagtatttagaatagatatgtccaaatgttttcacatttatatgcatagttgtgaaaatatggcaggtcagtccaagaacaagctctggactccaattcatagcagctgaatcaagactcttttcactaactagctttttgatttgggaaaaccactttaattttcatctgattcaatttcttcaacaggaaaattgggaataataacaccttatagaatcagctgttggcttaaaaaatgtatgagggactttaggtctggtacataggttttactcagtaaaatatactggctgatattgttatcattttgtatagccaaagctcatgtttttcaagtcaaatgctttgttcttaaaaaatggagacgagagcaaagtggagtgactcacacttgaaatcccagtgactagggaggctgaggcagaaggatcacttgaggccaggagttcaaggttgcagtgaactatgtgatcttgccaccgtactccagcctgggcaaaagagtgagaccctagttcttcaaaaaaagcatggtgggagaacctctttaatacttccattttttataattggtaggattctatctttaaaatgtcattttgtgatttaacatattcttttaagactttgacaggtttaagaacaatttattgtatacttactctgtaacagacactgtcctagaagtggaaacattaaataaaaattatgtcataatgaaggaggaatctaatagtagttaagaacagcagctctggaagcaaacagcctagactgaaatgttgcctgtaactcttccttaaggtttggcttaggaagtcactgcctttttgtttctattgttttctctgtaaactttaaataataactatatctagtattattttgaagttaattaagataaaatttaaggaacttataagagttttggctacagcaaaagtttaaaagatgcttagtgttattatggcttgaactctgaaaagaataaccaaaaggtagtagtggttattaataatttgacttactaagtatatttttagttccttagaaaataaatgaagttatgtagttatgctgatattagaccttcttcatcatttgcaaattagcaaattattatacctacttaacaatcttggtcccagcccattccctttctcaatgatatcctggctttgtctcacaaagttcttttgtttgtagtggaatcaggggagctgaatttttccctatattttctaacgacacaatcatatgttacattgtcttgccaagggtcactttgcgtgtaggctcacttcgcatgttacaccatgatatgcttggttcttcaacacactcctttacttatgctgatttggggtaagctttcttatttaactgattaagggctagagtcatgtaggctttcccagtctccacagaccttcagccttgattgtatggccacaaagtgagtaaacttcctggttatttctctttttcagcacttgctaactattgatgcttgaatactgccaaactaccagatagcagtcaggctagcttcataaacaatgttggtaaatctacaaaaactcgttttttgatgctgcaagattaatgactagatatgcactctggctattatatgtggttaagtttaaattaatgtaaatcaaacaatttttaaatgtagctctctagtcaaacccattccaagtgtttgactcgtgcttgtttttagataacaaagactagaataattgtatcattgcagaaagttctactggatggttctagatctagaacatggtaaatacaataaagtaccagccaacctgaaaaatctttctgtttagacaattggccattctctcctatcaacatattaccatctagcaagtttcttgcctaattttacattccactaagtgacatattataaataagtgttgaattgcatgtgtcagtattttaatgtataggcccttgcaagcacatgggtcaaaaactattgcaaaggaaacaagaagtataattattccaaaagtttctgttataagctattcatggtaaaaataactaagccatcagtaatttacttggtatgtaaaaagccaaatttcacactatagacaaaagtggaaggattgtttgaactggtatcttggatggcctgataaaagtgcaaaaatatcaagtaaatgaaaaagagtaaagcatgcaacatgtagttgtctaggtttttaggtaccaaaaaagcaaaaatacataagtaaataacatttctttaaaatgctaagaacagagaaactaaaaatgttcttgtataagacatggcaaatgaaactagcatttattcccctttattaatttgaaatttataaaatggcattgatattctacttatctaatgtgttacatattttttaacttagcatacaagcgtgacaggaaaaaaaacaaatatttagcatgctttattgttaagatttgtaaggtggcactaatttcttaatgtaatatgctattttaaaatcttggcataaaacgtatataaccttatttaaatagtctcttatgtgttgggactttgaattatcttccaaacagttatttatttatttaatcatttatacatttatttgctcaacaaatacttctgattctctaacatgagtcatgctctgctgggccctgagtggacaacagtgaacaagttagatccactaggaatgactaacattaatcaaataaccactggtgaatttatacttacaaaacagtgaaaacaatgaattttatggaatattgaaaggaaactgagttaaaggaaagactttcctgagaaaagaattctttaaatcagtactgaagcttgtggaacaatgttcttactgaagaaagacatgatctgaatgaaagctggcgtcatggcggtaaaggaagacataggtggtaccagttgacaccaaggacacagaagttgatcagattatacatgcctcttaggtcctgttgaaactttatctttagcacaatgtgaaaccttgaaaatggcttaaatcaataggaaaatgaaatcaacagagacacattttgataagataggttttgctgcaggatggagactcagtaacaggatggcagagtagatatgggagaaaattatggaaagcattttagcagtcgagatgagagaggacaataccttggacaaaggttcaggcagtgaaaataaagagaagtggataaaatttagagatccagaaagttataaagaaacttgcaatgaattaaatatacagtttaaaggaaacagagatggcagagataactaattcatagaagtaaattttcatagaattaaaagcatagattcacaaaagtgaatgcatagggatccaattattaagataggagactatgaaatgattttaggggaaatggtatgagtttaaattgagcataataattttaaggatggatgtggacctgggatgacgataggtcatatatatgtgtgtgtgtgtgtgtgtgtgtgtgtgtgtgtgtgtgtatatgtgtgtgtgtgtgtgtatatatatatagatataatttatataatggtactctgtgtcttctcttaaaaggaagaaatgagagaaatcagaaaatatggttagtaaataagaagtccacattggcatatcagtctgctataacatcttttaaaaagagccccttatgaaatcattctgaaggtcagactaacacctgttgctttcttagagtttgtgtttctgaaattctctgttatgtagcaaggccaaccactcccaatctattactttccacatctggtattacaacatgcaaattatcaagtaaagtttgccacagttggccttggctgaccatttcccactttgcatattatattcttttacaatctaattaataatatattaaacctgagcatttgcaagacacactagtaccattttaacttttctagatcctgacaatggagttttattaataattcataacagtgtgctaaataatgaaagctctgccaaagtgtctgtcatgtcatccaacccagacccttcctgagacctggccttccttgttgtacacaaatgctattggcagaactccataggaaaacatgtttctgccaatcaaatcccaggaggtgggggctacctgctgatgaatccacattgctgattcaattctgcaaaacataaaactccataataaatattttctaaaacaaaacatggtacctgaatgttgaaatgtaaataaaaatgaattaactatacagccatgagtgtttaaaaagaagggtgaaaattttatttgaagaaaaggagagcatatagagaaaatgtgcattacccaccaggctcaggaatatacagtgcattattatagtgcgttattttataatccttaatatatttagaacactggtagctgactaggagaaaagattaaaaacagagacagagagtgacatcagcaagatggtgaaatgggagatcctagctcccagtcccatgaaaaacactgatttttataaccacttatgggcaagaatacctctgtgagagtgcttgagtctgcctgaggttccagcacctaagtggagtaaaaaaaatccaagagtggacgcattaagaaggtaggaatcagcttcactttatctgcatcattcctccctcaaggcagcacaactctgtgtcgagaggcccacttggctcaccgttacttctacaggagaaagtgagacaaatgcaataactctgcttccccagacttgcaggatattgcctaggagacctacttttgtctctccccacccagaacactgaggggatttgcactgctgaatcatcaggaacatctaggagcaaggtgacagcgaaggagtgcacagcagccagtcccttgctctcaataacctgccgtcattcctgctaaccagctcataggctcctccaaaaggccagactactaagaaaagattaagctgactaagctagattaagaaagcttgattaagaaaaaaagaggactcaaatgaacataattataaattaaagcggagacattacaactgataccacaggaaaaaaaaagatcgtaagactattatgaacaattatgtgccaacacattgtataacctagaagtggaaaaatttccagaaacatacaacgtacaaaaactaaacaatgaagaaacagaaaatctaaacagtacaatattaagtaagaagattgcatcagtaatcaaaaattttccccaaagtaaagctcatgacagatggtttcattgaggaattctaccaaacatttaaagaagaattaatgtcaatctttctcaaacttttcccaaaaaatgaggagggaacagttccagattcattctgaggctagcaaagaacactacaagaaaaggaaattacaggccaatattcctgatgaacgtagatgcaaaatgttttgacaaaatacagcaaacaaaattcaaaatcacctttgaaggattatacaccatgatcaagcacaacttattctgggaatacaaggatgatttgacatatgcaaatcaataagtgtgctacatcacattaatggaatgaaggacaaaaccatatgattatttcaacagatgcagaaaaaaacatatgacaaaattaatcatccttttatgataaaaactcaacaaattaggtatagaagggttgtacctcaacataacaaagtgcctaagtggcaagcccacagctaacattataattaatggtgaaaagctgaaaggtttttctctaagatcaggaataagagaaaggatgcttactcttaccacttttatttatcatgtattggaagctcagtcatagaaattaggcaagaaaaataaatgaaaggcatccagattaaaaatgaagaagtgaaaatatgttttctgatggcataatcatataaatagaaaatccaaaagactctaccaaaaaactgttagaatagataaatcccataaagtttcagaatacaatatcaatatacaaaaatcagttatgttttataccctaacaatgaactatctgaaaaaaattaagaaaataatcccatttataatagtatcaaaaagaataaaatacttaggcataaatttaaataagttgataaaagacttgtgcatggaaagctgtaaaacactgatgaaaaaattaaagtacacacaaataaatggaaacatatcttatgtccatgggttgggagaattaatattgttgaaatgtccatactgcccaaagcaacctagagatctaatgcaatacggttcaggacatgctaccccaaaacatggcaccttggcatctgaaaaaacagatgaagaagaaaagtctctctgaccttgttgcattgtttccccctgaagttggccacataagaattctttaacccttttctaaagtaggtcataagactgtctttttagaggggtcctccctatacctggagaaaaggaatgaaggcatagaaacaccaagaagaatcttaagagaaaggcctttctgagttcccttcagtttgttaccattagatcatattattttgctctctaattatacttctgcatgactgtttgcaaaaatacatagttctccctgttaccttgggtgttcctttccaaagcctcctgtgtcacataaaacttttattaaatatatttgttatgcttttctcttgttaatctaccttttgttacaaggatctcagtcatgaacctagtaatggatgaggaaagaaatctcttctcccaaacaaatgtgatccctataaaaattccaattacattttttattgaagaagtaaaagtaattctaaaattcatatggtattacaaaagtcccaaatagtcaaagcgatattgagcaagaagaaccaaggtggaggcatcacacttcctgatttcaaattatattacaaagccataataaacaaacagtacagtctgacacaaaaacagacatacagaccaatgtaacaataaaaaacccagaaataaacttacatttatatattcaactaattttggacaaagataccaagaatacacaatggagaaacgatagttctttggtaagtgtgctgagaaaactgaatatctacgtgcaaaaacattaaaactggacccttatcttacatcataaacagaaatcaactaaaagtagaataaatatgtagacataaagcctgcaaccagaaaactagtagaacacaatgtaaaagaaaagctccttgacattggttttggcaatttttttttatatgacaccagaaacacaggcaatataaccaaaataaacaagtaggatcatatcaaaataaaaagcttctgcccaggaaacaaaacattcaacaaaatgaacaggcaacttatggaagtaaagatttgcaaaacacgtatctatctgataagggttactatacaaaatacataagaaactcatacaactgaatagcaaaacagacccaaacaaaaaccaaataaccttaacaaaaatgggcaaagacctgagtaatttgtctaaaaacgacatacaaatatgtaacagatatattaagaagtgctcaacattgctaatgatcaggaaaatccaaatcaaactgcagtgatttatcgtctcacaactgttaacatgggctattattttacaaaaaaaaaaaagagagagagagagacaacaaatttggtgagaatgtgggcaaaagagagtccttacacattgttggtgggaatgtaaactggtgaagacattatggaaaacataatggaatatgctgaggaaacatacagggtttaatgaaggagttaaagctagaaaaactgtatgacccagcaatcccaatgttgtgtatatattcaaaggaattgaaagaatcttgaaatatctgcattcccatgttcattgcaaaattatttaccatatccaagataattcaaccttaaatgttcattgatagatgaatagattaagaaagtgtcatatattcttacaattgaatattattcagccttttaaaaaaggaaattctatcatttgcaacaacataatgcctagaggacattatgttaagtgacgtaagccaggcacagagagtatttgtctcttacttacatgagagttttagtctgttcaggctgctataataaaatatcatagactaggtatcttataaacaatataaatttatatttctcagagttttggaggctggaaagtcaaagatcaagacataggccatttccatgtcttgtgagggtctactttctatttatagatggcacattgtcattgtgtcctcacgtggtagaagggactagctagcttctaggatctcttataagagcacaaatcccaatactgagggccttgctcttataatctaattacctctcaaaggccccacctcctaaaaccatcacctgtggggtgaggattcaacatatgaattcaaggagcaggcacaaatgtttagaccatagaaatgtataatctaaaatagtcagacttagggaagcaaagcagcatggtggttgccaagggcttgagtgaggagaaaatgaggaggtgatttttaaagggtatgaagtttctgttatacaagataagcaagttttagagacctactgtacagcatagtgcctataactaacaatactgtactgctatattttatacttaaaatttgctaacatgatagattttatgttaagtgttcttaccaaaaagttcccccaaaccacagattgtttataataaagggggtgggaggaagctttcagaggtgatgaatatgtttatgtcctctatagtggtggtggtttcacaggtgtatgctgctacccaagctcatgatgtatatattaaatatgtacagatttttatgtgtcgattatacttcaataaagtggtcaaataaataaattccccttaaaataataaaagcaggaagggagtatatattttttcaaaatggcagttccttaaagctgtggttttcaactttgcttattcaatcatttgttgcttaacgaggatatattctgagaaatgcatcattaggcaattacttcattgcacaaacatcacagagtatactcacacaaatccagatggtatagcttactacacacctagggctatgtggtataacttattgcttctaggctacaaacctgttcagtgtgtgactacactgaatactgtaggcaactgtagcacaatgttaagtatttgtgtaaataaatatatctaaacatagatgaggtacaataaaaaccagtataaaagataaaaaatggcacaccatttggtaggataactaccattaatggagcatgaaggactgaaagttgctttgggtgagtaagtgagtgatgagtgaacgtgaagccctagaacattactctatactactgtagactttataaacactgcaaacttagcctttcctaaatttatttaaatttttttcaataatacattaactttagcttactgtaaacttactttaaagcatttttatattttaaaattttttgattcttaaaataacacagctaaaaatgcagctgtacaaaaatattttttatacccttattctgtaagtttgttgctattttcaatttttttcttttactttttaaacacttgtgttaaaaactaaggcacgaacacacacattagcctaggcctgcacaggtcagaattgtcagtatcaccattgtccacctccgtatcttatcccactggaatgtcttgaagggcaataacaagcatggagctgtcatctcctatgatgagaatgccttctggaatacctcctgaaggacctacctgaggctgttttacaggtaacttctaaaaatacataagtagaaggagtacactctaaaataataaaacatatggtatagtaaatgcataaactagtaacatagttgttgattatcattatcaaatatgtactatatataattgcataggatatactgttatatgactggcagcacagtaggtttgtttacaccagcatttccataaacatataaataatgcataattctacaactttacaatgtatactacaatgtcaccaggcaatagaactttttcagctccattataatcttatggcaccaccaacatatatgcaatctgtattgaccaaaaagtctttagacaggtgataactatatcagtaacctctggggaacatttaaaaatttccaatgtcctaacatcatcagccaagcttctgatttaatgaatatgagatgtagtctgaccatcagattttttttctttttatttcacctaatgtaattcaaagatgattgacaccactgcattagagtcgtcttctcaacaatgtggattaaagaggcaaacaaaccgtaggtggatttgtgctttcctgaaccaaacctatgttaagtgtttgacttggagatttatctaaataaatgagggcaagctacaatttctaattgacaagtaaagtctaagacactgactaatacaggttggtttctctcattgattggattaaaagttctcacctcatgaaagtacaatagagtgtgtaaactcggattttcaattagaaagtaactctctttcatctaagcaaatttcatgtttccagttcttacagatttaatccttaaagccagaatatttatgaataagaacactgcaattttcactttttattctagaatgaatagacttgacagtaatctcagcctcttttcaaattttaagtaattagatgccaaataatatttccctactgccctaaggaattaagcaccaagtttttccctatcaaggactcccttcagtggagatgtacattctctgaattgtcaattcttgagtcataatagtggctctcatgttcttttagattttcaagatggaaaactcatatttagttatatcatcctgtttacttcccacaagtgatctgtcatcaaatctcatattttcctgagaagtatctcttagattctccagttgcttcttgttaccaagacttcatctagaacatcctcactactttttgggacaaattttttataggatgagtcaacactttaaaatataaattttaccaaaatctctttgtcaagagtatataattgttctatgtcactgataaggtgatatggtttggctgtgtccccacccagatctcatcctgaattatagttcccataatccccacatgtcgtgggagggatgtcgtgggagggacccagtgggaggtaactgaatcatggggcagttaccccagtgctgctgttctcatgatagtgagtgagctctcacaagatctgatgattttataaggggctttccccccttttgctgggcacttctccttgctgccacaatgagaagaaggacgtgtttgcttcctcttcctctatgaattttaagtttcctgaggcctccccagccatggtgaactgtgagtcaactaaccctctttcctttataaattatccagtcttggggatgtctgtattagcagcatgagaatggactaatacgtaggcaaactccaaactccagaatgctttcctttttaacaaataaaagttaaacagtgtcttaacttcttccactaacatttacttactgtacttgaaaattacccaaaggaaaacaaactcttttagttatatgaaagttgaagtctctgtcttatactttattctataatattacagtgtggatagtaggaaggacaagggtgttaaagtgaaatacaactggattcaaatgcttactttgttgattactgtttgctcatgagcaagttttcaaaactttttatattcagtttattcattgtgaagtggggtttaataaatgtcaacctattgagttgttatgagttctctacaaaaaatatctatcatctatctttctgccaatctttctatctctatcatctacattgatagcctatgccatatgttttgaacagttatcctcaataaacagaagctcttgttgcgatttctttcttttctttctttctttctttctttctttctttctttctttctttctttctttctttctgtttttaataacatagtatttatctacaatgaaaaacctgtactaggaagaaaatggcagtccttcttcaaaggggttaattttcttttgtaagattcaggaattgatggctgaggtgttatttttttcttgtttacagcataagtttaaaccacagaaaacatcaaaacctagcttggctttgtttagtatgtgtcataacttggtgattcaaaggatctttgctttttagcttccaagtgaaagggtttgtttatggtgtctacaaaggtaagaacaaaatttgctaattagaaattgaaaaacttagtcaatcaaaaggcctttgttgttaggttttgatcatggcaaaaggaggagttttgcatttgcctagatgcatacaaaaggcaatttgttaaaatagcaaaagagcagcaaaggctgtctgtttctctgcttactctgaatatactacaagtagaaagcataggctctttaccagttcaccagtaatcacatttttggtacaaaaggggactctgcaaaggcaaatttatttaggcttaaaaattattcatgttcttccttccaatcaaataccacctggcacaaatatttggccctcaataggagagaacctgtagtgggaacagaaccttgtaaatgagaggaggaaaacttattcaccactgtgacccttttccttttccttatggccttttctctgtgtgagaaatcagggaagtctgcacagctgacaggcaagggaggagaaactgcaggggcaaggtgcacaatgtggatataaaattctactctaagagagtgtggagggaagccacatttgagttgataacattattttattcctcttaatataagaagacactttttgtcatttaaattgatttggttaaaagaagacatagatgaaatagaaatacgagaggaaaggacatttttccttctcagaaactgtgtgcaggagtttgaaaatgcgggatagatggctgtcccaggagaatgatcgaggaaagtgtgatcctgcagtagtaaacgcaagcatgaggcatctttcttatttatacattagagttctttcaactcatatgtgatttaaaagaatattgaaatactaccaacagtgttttctcttttcctgtgaaatgcttattttcaatctcaaattaacttccatattctttaaaaactttccattccactcacagacacaggattttctcccttctctgacatatgatctttctttgtggagaaagggtcttttatactctggtggtgccagcattacccagggcagcaaactttcagcaaggcaatttgaaatgtatctgaaaaaatgtaagtgtatataccaggaatttatataaagaaaatgcatggactatgtttagaggatattaattgcaaggttaattataaattaagaaaaaaagaaacaaatctcatgtcctataacataggatcagttaaataagttatggaagataaaaaatggatagtatgcaatagttcatataaaaatatgtatttatatttacttatgtagaaatgaatttgaggtacaaatgtaaactacataatggtatgtgttagatgattatatatatatatatatatatatataactgcaagataattgcaccaaacttgttaactgtggttgtatcttcatgaataaagtttgactaatttaaaattttttcctaaatttttaatattattttacaatgattgtgttctccaatgagaaaaaaagcattgttatagttaggtactcttcctaatatatacttttgatctttctaactatactataagttccataatgatggggatcttttatgtcttggtaacatcccagccccctttatccacattgtgagttatcactccatacaccttcatcatagtcataatgatttggggttatttcttgcaaagaatatttattcccaggccattcctccaattcttatctaaagtctcaagagaagtaattctaggaacattgaagagtcttcaaatcgcacaagggtaaaatcagtaagctccccaaagctgaaattctaattctaaggttactcttgttcttagaataggcactggggaactctggggactgtctccttgactgttctgcattttgtctgtaatgcattctaaagatcactctccttgacattactcttctaaatcaagcatataaattctactcaggaatcaaagccactagatagtctgcatgcatttacactggggagggcaaagcagaggggagagccctagcagggctagcctgctaataaaacatgacttttaactccttgctcaggtcttaaattctctctcagtaacaatattgtataagccaaatgtaacatgtgaatatgcaaagctcatcatttgaaagaaaaacatcagccttctccaattaggtacatttgctgaaataaagggtggtacttatcctccatgtaacatgatgttgctaaatgagaagatctgtagtcacattataccttccagggaatgcttgtcttgtatgttttctttgggttttttctagagcttcatatcagacagcacaacacttgtacatttccaaactgatttgcaggatgatacattcagattctcagaggaagcctataaaacaaatattcgttgagcatctaatccagtctatgagccttgcctgaaggagatgggaaaaaaatgacacggctttaacctcagagggtctacagaaaaggtgagggaataaaacttattaataaaagtaaaacttaggcaatagtttctggaatatctatgtcaaggattagggttgccagattttgcaaataaaagtacagaacaccaacttaaatttgaatttcagagagacactgaatcatctttttatatatttcacgaggcatagttgtactaaaaacttatttgctgttaatctggaatttaaatttaactggctgttcagtattttacctgacaaccctaccaagtcacaatttttaaacgactgctaagttagaattgaagagtatagaatagtgattgacagaaaaaacaggaaagaaatgcaagatccactcaggttacaaagataataatttagtccattaaaaatgggtaagagaaactgggtggatgtgaaactaattccatataaaatcttggtttagaattcctacttgacatagtagtcagaattctgttacgaaaggaactgactatattcatatatgctgaaggagaatccagtatgcaatatccagaaagagatcctcaatgaaatccttttgacttcgagataacactgcagctgtcccaatttgtcaccctgtaacttcaacctgctcaatttagtaaaattactcctttttaagtcaatcagtgactacaaatcaaaaacggttgtaaatagtatagagacaatgaagtaaataaaaacaatagcattcacatttttggataatcgatcagtgtcatttactcatctacttatttttgaaatattaatattgttcttaaaatgattttagactttcaagtttaattttgcaagtgtaaaagaatttgattatgtgggttaactgtacttaacaaaataagaggaactgatctatctatcagattgaattattagattcacaagggttgcttaagacctagggagaacttgcacgtgaagttattatgtctgcctgtcagccatttgaaatgcttttacaaaattcaaatgtattaaatctagtaaatcatacttgtttttaaatgttaatctgtttaatttgagaaattaagcatttatcaaagaataaataaaaagtatttttccatttttatacaaaatcgactgtatccatgaatggaacaaaatgctaataaattaaatttaaatattgatattaataagttaaaatattgataagttaaactcaaagcttaaggacatttaaattataacttaaatttattccatgtaatttaaactgaagcattttaatagttctttctacgtacatactatggacagtaaagcctaagatgataataagaagatatttaaattccagggagtcttaccttcttacaattcttataattaccagttcttacaatattttgaaaataataaatctcctagtcagagttcagtagttaaggggaactccgaacactctgattaacatcctttgctttttaatattctgaagaattaatatgggataaattagacttaatattgtaataataaaagctgcttaaattcaactgttactgatatagttaattccatttctctgaaatcacttagtgtacatgcctgttttagtaaggatagcaacaggagacagaaaaattctaggcagacaggggagggtccctggcaaaaccttaccttcaagccaaaaagcatgaaacccatggccctaagtgagaactttcatccctatgtgcccggtctctcccaatttgttctttctgaatactgccttttaaccaatcgaatgttgcattttccaaaactactagcagcccaccctgcccccatcctatgcctataaagatcccagccagcagaggatagaagcagctggatgtcaggaagaatcagctggatgttggagagaagcagcttgactccagagatggcaactggacatcaaagagaggcagtttgacttcaggggagagcgaccttcccttcccatccccttttcagctcccctctctgctgagagttgtcttcatcactcagtaaaattctccacattcaccatcctccaatttatccatgtgacctcattcctcttggccactggacaagaatttgggatgcattaggtggcagtacccaaaaaggctgttacactagtcctttgccctcactggcagatggcagccagcccacatgatgaatcaaagggcccactcaactgataacacaccgctgtctgcagatggcagagctaaaagagtactgtaacacaccctctgtgtccttggggtcacaggcatcccatctgcaggacccacatggagtttgctcctgctggtgccaaagcagctggttcctgcacttgcttgctcctgttcctgcactcatctgctcgcaaactctcttccgcaaggggatgcgcaggtggcctgagtaaatgaggcattcttgtcatgactcccacaaaggggtcaagaaaatatactgcatcaataacgtaccagaaacaacattatagccacgtagcaatgaatgagtatcattttagtgcaatagaaagagcagtacatggcttctgcagataacccaagtctttagtttttttctttttagatcaattttattttttaattgacaaataatagtcctacatatttatggtgtacaatctgatgttttgatacatgtatacactgtgaaatgatcaaatcagggtaattagtatagctatcatctcaaatatttaacatttctttgtggtaagaacatttaatatcctctttagcctctcctgacatagggggacccaatctctaaaaaaattaaaaaatgagccagacatggtggcacacacctgtggtcccagttacttaagaggctgaggtaggaggatcatttcagagattgaggctgcagtgagccatgataatgccactgtactccagcctgagtgacagagtgaaaccttgtcccaataaaaagaaatcctccctttcacctattttgaaacatacaacacattattcttaatgatagtcaacttgctgtgcgatagaacaccaaaacttaatcctcttatctaactgtaactgttgaccaatcctctttccttgtccactttcccccaaccctcacctccacccccacctacctctggcaactaccattgtactcacttctttcataagtttgactttttaaattccacatataagtaagatcatacaatatttgtgtcaaagacaaatatgctctattcctggctaatttcattgaacataatgtcctctagtttcatccatgtcataaaaaataataggattaataaagttaggttactagatttgaaatttaattccttcaccaatatttactgggaaattgtttaaaattacagattcctaggccccttctccattgtttcaataattgaggggggtgggcaggaatctgaatactctaaagtctctccagttaattctaaaaattaggcaggtagatatggagaatattggcctacaaagtcctttgctattctaaaatttcataaggacaatcttaaagactgaacatagcccttaaaaaagaaatcataaccgaataaaaacttaatgaagtgtgttttttaatactcattcgaaaaaatgcctgttaaaatgcgtattttattatagatagagtcacatatttttgccataacaactcagagtatccccctggcttctcattgaagttaagtcactatacatatttatcttatgcctatgagacatttaggagaaagaacttggggtctttaataaatagtattcatccatattgaccttttctcttctgttatttcaagaaaattcggcaagtatttggaaatttaatattcatttattgcatgggatcatttcagcaagcttcccttgatttagacaaagacaaaatacctatccacaatggttacctctcaaatctgttttttttaaaccaaaatattgcagacgaatgaagtggaatgaagccattcctgcacaaagatgtccagagcaaagaaaaacacatatttcataacacagctgattctcaaagtcaacattacatggtgttgcctacaattctatgtaaacagtatatgggagtagacagcagcaagagaacctggttagtttgcaatctagtatcttggtcctaatattttagaaacttggttgttctcaatgcctaattgatgcccaattggtaacaacagcctcatttcagttgttgttgttgttattgtttttcttccctgagtggaaaatggatcagtgctttggggcagctgagctgatttctttttgaattgaaaatggatccactttacacaaaaaaataattagaaacttccatatcacacactgtcatgtgctaacagcctggaagacgtgcccagtgaaaacaactgaaagtgttggtttggatgttttacacacacacacgtgcatgcgtagatgccctgatgtgtgctggcaagttagtaagatctatccagaggctaaaagtccaaggagaaatccagagcaaaaactgatctttatggtagaaaactggagctgtggttttcatttccttttgggcagcagaaaacaaaaacaaacaaacaaacaaaaaactagccaaagcacaggacattctaaaataggtctctcagtaaatgagatctaaagaatgaacataaaagaaacgaatgaccttcctcaaatgaggaaatccttgccttggttctcaacagttacaaaaaaggaatttcctttgaaaaattataactataatctcaccttcaaagatattatagtccattgaaatattatctagatggcctgagggggcttcaggcagagaattaagttggaggtgatcttcatctagtggtcatcaaggcagaaggtgacatgcccactacaaatgaagacctcaggtaatttccacaagattaaacaaacatgaatttatgataaaagtcacaatacacaatgaaataaggcaccatgattgagagaaactacaaacagcattttcagtcctataaacactatccgtaatgaaagactatccatgttgaaattattagacaaataccataaaatttatgtttaatatgctaaacacaatatgacagcatggaaaatataagcaaaatgcaagaaatcatttttaaatgaccaagctgactaaaaatatacctaaatagaacttctaaaaataaaaattacagtaatttatatttaaagattaaaagaacattgagtgaacaaaataagctaaataattgataatctggaagataaatctacagtaactatcatcaagcagcccaaaaagataaagagatgggaaatatgaagaagttaagatacatggaaaatagagaaaataaaatataaacaattacagaaagatgaaagaaagaaaattgattggaagtaatatttgatgtgaatgttttggaactactgaatgccaccaaccacagattcaggaaaccaatcaaaatgtaaacaaaaacaaatatataaataaataaataacaaaaatccacagttagatatagtgaaattataaattaccaattgaatgaatatgtggataactctgaacaaatatttatgtacaaagtaataagaacaacacaaacaatgccttactgagttttaaaatgatttagcttttataattatgtatggtaaatttttaagtgtcatttctaaaaatatggaaacagagtgtgtaacttccagtgaagttgagggggtaaaggatgtaataagaaaaataagttgagggaaacaaaaaggagagaaacagaaacataagaagacagaaaataaaacatattagtcctctaagaaacagatgccaaaatgggattagaggtgcaaatagattggggagaaaatgtctgtgaaagataaagaagagagagcaagaaaaggtgaaatgagccatgatgattgctgatacaattgaaggaacaaggaaaagaaagaaaattgcataggaaaagtcttagatttaagtgcagttattttaaaaaaaaaaaggttttgccaggccaaagaggagtccctgattcaagtctgccattagctatatctgtgtctaacaaaaacaggctggcaggagcaccccagccatattctctcttcggctgggagaagccctggagaagtgtgacttcttgaaacaagagagtggatccagaagggaagcaccaagggccataagtcaactaatgttaaatctttcaattcatcatgtctatatatatgaacactatacatatgataaaaagctcaatgtcactgatcattagagaaatacaaatcaaaaccacaatgagataccatctcacaccagtcagaatggctattattaaaaagtcaaaaagccacagacgctggtgaggttgtaaagaaaaaggaacacttttacattgttggtgggagtgtaaatcagttcaaccattgtggaagacagtgtggtgattcctcaaagacctataggcagaaatacgacttgacccagcaatcccattaccgggtctatatccagaggaatataaatcattctattataaagatatatgcccacgtttgttcaatgcagcactattcacaatagcaaaggcatggaatcgacctaaatgtccatcaatgatagactagataaagaaaatgtgatatatatataccatggaatacaatgcagccataaaaagaaacaagatcatgtccttttcagggacatggatagagctggaagccattgtcctcatcaaactaatgcaggaacagaaaaccaaacccctcatgttcttactttataaagtgggagctgaatgatgagaacacatggaggggaacaatacacacagaggccttttggagggtgagggttgggaggagggagaacaccaggaaaaatagttagtggatgctgggcttaatacctaggcaatgggatttgtgcagcaaataatcatggcacacatttacctatggggcaaaccttcacatactccacatgtaccccagagcttaaaataaaagctggaaataaaaaaaagaaagtgctaaactgtcttacaaagtggctgtaccattttgcatttcaccagcataaacaagggtttctattgctccacttcttcatcagcagttcatattatcactttttaaaaatttttgccttcctaattagtacgtattattttatcattttttcctttttttttttttttttccagacagggtctcattctgttgcccaggttggagtgcagtggcacaatcagggcccactgcagccttgacctccctggctcaggtgacactcccacctccgcctcctgagtagctgggactagtggcacactttgccatgactggctagtttttttttttttcttttttctttcttatgtatgtatgtatgtatgcatttatttattatttgtggagatggggttttgctatgttgcctaggctggtctccaactcaagcaatctgccaccttggcctcccaaagtgctgagattataggtatgagccactgtgcccagcagctcattgttttcttttttgttttttcttttctttttttttttgagacggagtcttactctgttgcccaggctggagtgcagtggtatgatctcggctcactgcagcctctgtcttccggattaagcaattctcctgcctcagcctcccgagtagctgggattacaggcatacgccactacgcccagctaatttttatatttttagtagagatgtgtctcaccatgttggccaggctggtctcaaactcctgacctcaaattattcaccctcctcagcctcccaaagtgctgggattagaagggtgagccaccgctcacggccccattgttttcttaattttcattttcccagtgacaaattgcaaaagacaaaagtctgtggcttgtcttcattttcttaacagtaacttttgtggagaggtttttaagtttaataacattcaacttagcaattttttcatctatcatgcttttgatgttgtatctaaaaattcatcatcaaacccatgttacctagatgttctagtttttgttttaagttttatacttttgtgctttgaaccatttttgtatgtgtgtgtgaaaggtataagatttgtgactatcgcttctcgaccttttggctaagatcaggtgaagatttgtgtctaggcccctgctttgtgcgtgttcatctccagttcttctagcaaaaattgtttaaagactattatttctctattgaattgcctaccaaatatcagtttattatttagagtgtttctatttttgagctattttgttccattggtctatgtttccattacttcaccaataccatgatgtgctaattgcagcaactttcataaaccttgacattaggtattatagtgcttcaactttgttctttttcaggactaagtagtagaatttattcagggaagtggttattgctgatggagaagggatacacaaatgacttcaaagtaatggtaatttattatttatttaaattaggtcataaataggtgttcttcatactttgtgtatgttttataagtatttctttgtatattcttagcattacataacaacttaaaaacatttcagcttgaatccaactttatgcatctatgaacacttgcaatgcacaaaggactcaccaaacccttgtggaaggaggaagcatgtgggatgaaggcattttttggccacttgttgactctaacagcactgaagtctcactaaatggatagagctcagagatggctaacagtttaaaacaattatatttaaacaattatttctctaaatgttgcataggaaaaaataaatttgtgtaggaatgttgaacagaaacaggaagactgtcaagaagagtgacaatggcatttggtccttaattaaaattcaattatccaaatctgaatatattactttcctttttcattgctaaccattgcatagtaaataacgccatgctctttatcacatataatattgttactcataaacacacgttaaaaattaataacattaagtgtttactatgttccaagtttctttctaaatgctgcatgtaggagctcatttcatcctcacagcaagcctatgaagtattatcaacatttaagcagttagaaaagtagggcagttctttgaatccaggacacttgtattctacttactaaatgcatttgatgttgacaatgataatacacattttatatccatctattatctaaataccactggccaatgctgtgaggataaaagagtcgatgaaacagacttttcactaaagcaaatcaaaactctaacagaatgtaatgaagtaaacctacatggactaactagaaaacaatgcagacagaaaattctacacccgttctcagagatttattactgtgcataggtgtttacagaatttagaaaatgaaacaaaaatgaaacaaaactgtggatttgggaggacagagaagattgatctctatgagctgaaaattcctaaaaatcaataaagacactttagttaccttactactattaaacaaaaaatatgggaagtcattgttttaggctgaggtcctgtactaagccccaacagaccagaccaaatcagaaaggagtcactcatgctaaataccacattatcaaacagaaacttcaaggaagcaactagatcccaaaacagatcagtttgtcacttctgctttagctttgacaaaaaagtaacctgatgttatccaatccattttttttctattgtttcatttcttagtgtctaacttataaaatgcactcttctactattgaccagggaacactttcttcttattttgtagaatggatgctgcttcaatcatgaattttgaataaaagccacttagctttataactaaatttgctgtaatgttgtcttgtgacattatcttgctttcacttttctttgcacacagtaggtgttcaatacatagctaaagaattaaaaaacaacacaaaagaaaaaataatggaggaattgaattttagttggtgcttaaaaagagtgagctttcctgtgcagaagagaagatctaataagagtaactgaatgagaaatataatgttgaaacactggaataaaatgtaatgtgtgacccacatgatccctcatactttagaacttgttcctttgttaaatatttatcctcgtctcactgtgacaccacagcttctttaggacaggggccacatattttacttattgcagcacttctcatagtactccttataagttagaattcaataaacactgactttctggagactgagaatttctctctcttttcttattgcctttgttcctgagaattacattgcctcacagaagactaacacatgaaatcaattaccttctcatttacattattctatttatagtttttttctaatttcatgggaccatacaaaaatttctcaagaaaatcattcacttatgaaatactagaaaattcctgcatgaaatattgaagagaataatttatcatatttgcaagtttttaaaaaagtatagctgtcataccccaaaataaaaggaccaaggctctctagagaagtggctcattccagggctgggacaggcaaaatcctggagtatactgcagtgctaaaaagtaaagaaaggccaaaaattaaaaaatggaatatgctgaaagacacaggagccaacctgaaaaagttcccaatggccaaaggtagaaccacttgaataataaaataaatgttgatagctctgattttaactaaatattcataaataagtgaatgaataaatatgcgagaaagggcaacccttagaggagaattataatgaaaacatgtagaacgaattacagaaacagaaaatcagcattggaaatcctcaatgatgatggctgcaggcaagatctaccaatgagtgccaaaaatagtgggttaaaactgaatgagaaacgggatatttgcacagactcaaagtagctctcttaaaatatttatctttctaattgtagacagcaatatttaccatacagtgaagaaacctggcaaataccactgtagacaaacgatcaaggttaatatcaccactaagaaaatcatcatgcactgtctcataatgaactgaagtcatatcacttctgtgcttttcttcccaataaggagatactgcgcataggtgtagagttaatcatgagaaaatattaaccaatcccaaactgagggacattctacaatactagaccagtactcttcaaaagtatcaagattaggaaagacaaggaaagactgaggaactgtcatagactggaggagactaaggagccaccacacctagatgcaatgtgagatcctaaattggatcctgaaataggtaaggaatatcagttaaaaaaaaaaaaagctgataaaatctaagtctataacttcattttttggttatttttttaaggtgattattgttatgctgttttttgtactataataattattctgtatatgtcaattttgattttttagtggattggatttctcatgaatgggaaaataaatctgtataataatactaattaaggactttctcactaatttcatgtcctgagcaaaattatttgtgaaaaatattttttccagtcttttattgaagggaactagaggtaaataacttcgtaatgtctgcaggtaagtttgcttttggcaagatttgcatgaagggttgttgaattttgtcgaaggccttttctgcatctattgagataatcatgtggtttttgtctttggttctgtttatatgctggattacatttattgatttgtgtatattgaaccagccttgcatcccagggatgaagcccacttgatcatggtggataagctttttgatgtgctgctggattcagtttgccagtattttattgaggatttttgcatcaatgtgcatcaaggatattggtctaaaattctcttttttggttgtgtcttctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctgcactctttttggtttgtaagctattgattattgccacgatttcagagcctgatattggtctattcagagagtcaacttcttcctggtttagtcttgggagggtgtatgtgttgaggaatttatccatttcttctagattttctagtttatttgcatagaggtgtttgtagtattctctgatggtagtttgtatttctgtgggatcggttgtgatatcccctttaccatttttttatggtgtctatttgattcttctctcttttcttctttattagtcttgctagtggtctatcaattttgttgatcctttcaaaaaaccagcgcctggattcattaattttttgaagggttttttgtgtctctatttccttcagttctgctctgattttagttatttcttgccttctgctagccatccccatcaagctaccaatgactttcttcacagaattggaaaaaactactttaaagttcatatggaaccaaaaaagagcccacatcatcaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgctgcatatctacaactatctgatctttgacaaacctgagaaaaacaagcaatggggaaaggatttcctatttaataaatggtgctgggaaaactggcttgccaaatgtagaaagctgaaactggattccttccttataccttatacaaaaagtaatttaagatggcttaaagacttaaacgttaagacctaaaaccataaaaaccctagaagaaaacctaggcaataccattcaggacataggcatgggcaaggacttcatgtctaaaacaccaaaagcaatggcaacaaaagccaaaattgataaatgggatctaattaaactaaagagcttctacacagcaaaacaaactaccatcagagtgaacaggcaacctaaaaaatgggagaaaattttcacaacctactcatctgacaaagggctaatatccagaatctacaatgaactcaaacaaatttacaagaaaaaaacaaactaccccatcaaaaagtgggcaaaggatatgaacagacacttctcaaaagaagacatttatgcagccaaaaaacacatgaaaaaatgctcaccatcactggccatcagagaaatgcaaatcaaaaccacaatgagataccatctcacaccagttagaatgacgatcattaaaaagtcaggaaacaacaggtgctggagaggatgtggagaaataggaacacttttacactgttggtgggactggaaactagttcaaccattgtggaagtcagtgtggccattcctcagggatctagaactagaaataccatttgacccagccatcccattactgggtatatacccaaaggaccataaatcatgctgctataaagacacatgcacacgtatttttattgtggcactattcacaatagcaaagacttggaaccaacccaaatgtccaacaatgatagactggattaagcaaatgtggcacatatacaccacggaatactatgcagccataaaaaatgatgagttcatgtcctttgtagggacatggatgaaattggaaatcatcattctcagtaaactatcgcaagaacaaaaaaccaaacaccacatattctcactcataggtgggaactgaacaatgagaacacatggacacaggaaggggaacatcacactctggggattgttgtggggtgggggaaggtgggagggatagctttaggagatatacctaatgctaaatgatgagttgatgggtgcagcacagcagcatggcacatgtatacatatgtaactaacctgcacattgtgcacatataccctaaaacttaaagtataataataatttaaaaaaaaaaaaaagatttgcagccagccgtgtgaacactctcagcagctgttcaagtgttcacgccttctgcgtgctcagtcatgtcacagcatgggtatgactcattctaccaagacactcctcatactggctatactcagattcccctttataaagcaaatattcatttatttattttacaaaacctgtattattctatattacaatgcaaaaggttggccagggttggaggttcttttgtctgccttatgattgctgggaggatgtataatttctgttcagccctcttaagttggaacagacctctgcagcaggaaacagattaacaagagaaagacaagcaagtttattaatgtttgcagggcacatctcatgggagaaactgctatgaaaaataactcaaaccagtggttttagaacttcggcttatatagcatcttcaacaaagaacagtaattttagagaagtggcaagacaaaggaaagcagtttttaggctcacagaggtgagaaactgtgggaagataaacatatgggaagaagttaatggagtaatgtttgtagattcctctagtaccatctctgagctgatacgagttattttctcatcttagtacaagggagccatccttcccacaagaatttttatggcttgctacatgtaggaaagggcaggtaagatagctccttctgcaactgctatttttccagtgccttcagttcaaaatgatcagtatgctaaatcagcatattttggggtggcatgttctggtttccttcactatatactatttctctagcatcatgtaaatgctgcaaaatctgtaaattactaaatatactaaaatatagtacagagtaatcaaaatattgcaatgattatagacattcagtgatttatggctttggaaaattccaaagaaaggaaaatgaggaaaagtcctaaacaacaaaatagaaaagctctttcacacacacagacatacacacacacacgtacacacattgcacacttcatgatgttaagaatacattactggtattaatggatcatgtttataaaacaagataaaattatgaccttaatacaactattaggtaaatgaatatatgtctaagattttatctaacatattaattagtgacaaaaccgataagatgctaaaaccaattcaaaggaaaatccaaaaaaatgtatatgtgtaggcaatacatactgtagtcaatctaggcaatcgacaatgttgacatgaatttacaaatagatgttaaactgatcaatatccacaggacaaattttatttgtttttatatggataagaaatcatttgcattacaattggttttcagcacagaattacaaaatatctttaaggcaatgaaaagtgcagataaacaagaagggtatgttagataggacatcagtaatctttaggctcagtttcaacatcattcacaatatatactaatactgggtacatcaatgaaaatcttcctctacctttcactgactagcccaattattcattcattttataaataaaatatatttattaaacttttactacatgtcatgcactatcccaagctctaagcttataaagttaaatactgtgaaggttctgagttttatcctgctggcaaggtaactagttagccttccacagttttatatacatatgctgcagaataaaccctcagtcagaaacacagtttttgtttatttgtttgtttttgtttttgttttttgaggcggagtctcgctctgtcgcccaggctggagtgcagtggcgcgatctcggctcactgtaagctccgcctcctgggttcacgccattctcctgcctcagcctcccaagtacctgggactacagacacccgccaccatgcccagctaattttttgtattttcagtagagacagggtttgaccgtgttagccaggatggtctcgatctcctgacctcgtgatctgcccgccttggcctccaaagtgctgggattacaggtgtgggccactgcgccccgccgaaacacagttttttacagtaaaaatcatcagcaagaacaatgtcttagtcacacttcccagtgctgctatccccgtagggcaatgggatgaaggcagatgttaacctgtggatgtagtaagtttgcatcacaggggagggaccctaaaatttagagcctcttagttatagactgctgacacatgaccatcttcctctccaaagacagagattactcattaaatacatttcataggggaaagagaaacggcatctctgtagaaagagattttatctttaggaggacacaatttctagattccaaggctttctggtatgcaaaattcttaacagcaccctttgctcagaaggcctggaccatgcaggaatatgatataaccataatgaattatctcacaacataaactactaaaagaaagatcttcagttttagtatattatattaaaataatcacagtacaggatgtttacttgggatatttatttgcactaagactgtggaagcaaagaagaaaaggaatgcctaatctgtttgtgggcgtcaagagaatattccaaagaggtcaaaattttaatattgaaatgaaatgggctaaaatgaaaagaatgtctaagaaatgcctgagcttgttgatatggaaagcatttcaacaggaagaaatagtatgtgcattggaaaggaatttggaaagagagtgttatttgttgaagagaagcagtttaacattcttcagttatgaagtaccaggagacagaataaacacagatgtagaatctatactgtgaagagcattgtataatataaaaattagttggatgtaatatgtttttggcaatgtgtaaacacagaaaaatgttggtcagaaaaaaaaggattatgtttttaggtgtgaaagaattttctggcaaaacattgttgagcctggagaagtaaggcaagaagcaaaaagggaacaaattcttcttttaacccacgatcttaaaaaatatacagtaaaccgacactttgattgatttgatattgttatgtacacagattacctttacagaaataccaaacattcatagctataaacctgctttgatgggaccagaacaattcttatgctcttattgtagattatgccaagttgtggaattacaatttgagattcttatatctcgaaaaataaattatatgtgtaattatctcacactttagttgaaataaatttacatagcaaactcaagagttttgtcatctaacataaatctgatcatagtttgtcccactttgagaaaaaactggaactttttactccacaacatattcctattttaaagctgactggaacatcagattaaaagccttcctttacactgtatgttttaactaaaattactaaaacaggtatttacattttgtgtgtagaggaagattccctaaagaataacaagttggactgatggtcttatgtttttcattgtagataataacctgaggttcaggtcaaagccaaggtgaaaatccaggaaatgttagacagagagggcaaattgcatcttttacttactcatttttgagataatttaaaatttttttccaaagcattaatcatttattaagtactaatttttatgctaaatacaggggatatatataaaaaattaaaataaaaaaaaaccttttggccgggcgtggcggctcatacctgtaatcccagcactttgggatgccagagcgggcaaatcatgaggtcaggagatcgagaccatccttgccaacatggtgaaactctgtctgtactaaaaatacaaaaattagctgggcgtggtagtgcatgcctgtaatcccagcaactcgggaggctgaggcaggagaatcacttgaaccagggaataggaggttgcagtgagccgagatcgcgccactgcactccagcctggcaacagagtgagactccatcacaaaaaaacaaaacaaagccgaaaaccacttttaaggagtatctctgccctcattacatttacagttgtaagaatctaagtttaaatattaaaaattcagagcagagacagatgttgaggaaagggtggatagacaatacaaagcctactttgccaagagtagagaagtctggtagggaataaacatgggggtattagaattgtggtaacactcagagcacctaactctctgcctactattcaaagttcataagatgtctgtgttggtaatctccttattctttcaagcatttatttaatccttatgtgccatatgaaaaatgatgctcaaaaccaatgtagggagaaaggcaacaactcttataagagttgtaatataatatataataatataagatccaacagttgtatcccaggtcttcattccactctccactcccccataataatttacttgagaagttgtttcagttctttctaaattctggtcccttgtctgtcagtctattctctaggtaaaattccatgtgtgtgccacctcttaataaatccacaatctagacactgggatcagccctgaagcatgggtttcaattcctccaatttcttctccttgctcaaatgccaattgtgtttttcatttccaggctttaaacattgctgtttatccaaaatttatcttattcataaaaaggaccctctactcaaaattctaatctttgtttctatttgaacccaccatttcatactgtattgttataacaatataataatattaactatattactgctaaaaatgtataagcaataaaatattattttctgatgatatatatactgtctgcttagaataatttctagtaattattcttttagcctttactactgtctaacaggctagatgtagttagaatataaggctttacctctatcagaaaaatgtttaaatctacccttccattgggtgatgcaatttatgcaaagagggagttttatgtcagtgcttgtctcttttgagtgagaatagagtcaatatgcaatgagagcaagatggcagaattgaaggctccaacaatcatctcctcccatcactcccaccccacgaacactagtctaacaactgtctacacaaaaaaaccatcttcataagaaccaaaaatcaggtgagcagtcacagtacctggttttaactttgtatcactgaaagaggcactgcaaaggtcaaaaaccagtcttgaagagccaaggccacccttcccccacccacaacagcagcaacgggcttcagagagcatttcatgtgctgcgggagagacagcatagtaattgtgaggcatcacatcagcgctgttctagcatagcagaaaagaaatccagaaaaatctcagctgaagcccatccatggaagaagcatttaaaccagtcctagtcggaggagaatcgcggatcccgctggcctgaacttgagttcccacaagcctcgccactgtgggctaaggtgctgtaaggctctaaataaacatgaaaggcagtctaggccacaaggactgcaagacttaggtgagtcctagtgccaaactggacccagaaggagtagactagggggcacacgacctactgaggcaccagctggagctgctaagagagctctggcatcgccacttccctaactctaggctgcacagtttgccgctctgaaagagaccccttccttttgcttgaggaggcaaaagggaaaagtggggaggactttgtcttgcatattggctaccagctcagccgcggcaggacagggtatcaatcggagacctgaggcccctgtgccagactctacctcctgaacaacatttctaaacataccctgggccagaatggaacctactgccttgaaaggatgggcccagtcctggcagcattcatcacctgctttctgaagaacccttgaactctgaaaaaccagcagggatatgcaggtactacattgagagctttccgtgagagtctgagacttgctggtgtcaggtgagactcagtacattcctagctgtggtggctatggggcaagactcctgcctgagaaaagcaggaggagaaataaaagggactttatcttgcatcttaggtactagtttggccaatgggggatagagcaccaagtgagctcttggggtccccgattccaggacttggatcttggaaggcatttcttttttaaaagttttttatttaaaattttttgtgggtacatagtaggtgtatatatatttacagggtacataagatgttttgacacagccaggcagtgtgaaataagcacatcatggagaagagggtaactatcccctcaagcatttagcccttgagttacaaataatccaattacagtatttattttaaaatatacaataaaattattattcactatagttaccctattgtgctatcaaatagtaggtcttactaattatttctattttttctacctgttaatcattctcaccttccccaaaatctcccactacacttcctagccttcggtaagcattcttatacactctatgtccatgagttcaattaatttgattttgacatcccacagataagtgagaatatgtgatgtttgactttcagtgcctggcttagttcacttaacataacgatttctagttccatcctcgttgttgcaaatgactgcatctcattctcttttatgactgaatagtactctattaaatatatgtacaacatttttgtatccattcatctgttcatggacacttaggttgcttcccaatcttacagcctgttaaaagtgcagcatcaaaaataggagtgcagatttctctttgatatactgatttcatttcttctggatatatactcagcagtgagattgctagatcatatgtagctcaatttttagtattttgaggaacctgcaaactgttcttcatagtgtttatactaatttacattcccaccaacagtatttctttttctccacatcctctccacatcctcaccagcatttggtattgcccgtcttttgaataaaagccattttatctgaagtgagacaatatatcattgtagttttgaattgcatttctctggttatcaataatattgagcaccttttcgtatgtctgccatttgtacattatcttttgagaaatgtcccttcaaatcttttgcccatttttaatcagattattggattttttttccctatagagttgtttgagctccttatatattctggttattagtcccttgtcagaggggttgtttgcaaatattgtctcccattgtcagggttctctcttcactttgttgattgtatcctttggtgttcagaagctttttaacttgatgtgatcctgtttgtccctgtttactttgtttgcctgtgcttgtagtgtactgcttaagaagtctttgccctgaccaatgtcctggtaatttcccccaattttttgttgtagtagtttcataggctgaggtcttagatttaagcctttaatccattttgatttgatttttgtatattgtgaaagatagggttctactttcattcttttgcatatggatatcagctttttctagcatcatttattgaagaaactgtcttttccccaatgtatgttcttggcacctttgtcaaaaatgagttcactctaggtgtgtgaatttgtttctgggttctctattctgtcccattggtctgtgtgtcttttttttttatgtcggtaccatgttgttttggttactacggctctgtagtataatttgaagtcaggtaatgtgattactccagttttcttcttttttgcttaggatagctttggctcttctgggtcttgtgtgattctatgtaagttttaggattgtttttctatttatgtaaataatgccattggtattttcatagacattgcattgaatctgtagattgctttagggagtatgaagattttaaaaatactaatttttccaatccataaacatggaatatttttctattttttggtgtcctcttcaattttctttatcagtgttttatagttttcattatagagatctctcacttctttgttaatttttaggtaattttatgtgtggctattgtaaatgggattactttttatttctttttcacactgttcactgttggtctatagaaatgctactcacttttgtatgttcagtttatatcctgtaactgtactgaatttatcagttctaatacatttcttgtggagtctttaggtttctccaaatataaaatcacactgatagggggtagagaaattctaggcagaaaagggcgggtccctggtgaagcctgaccttcaagccaaaaagcctaaaacccatggcccaaagtgagaatttctatccctgttttccagctcaaatgttgccttttcctaaaccacccatggccctgcctcacctcatcctgtgtctataaataccctagactcagccagcagaaggaagaagcagctggacatcagtgactatggctggatgtcagagagaagcagctggacttgagagctacagcttgatggcataacttcagggaaaaatccggccggagatggtcagtcttcagaggaagattgcctaccccctccccgtcaccttttcagctccccttcccactgagatccactttcattggcaataaaatcccccacatttacaatccttcaatttgtttgtgcaacctcatttcccctggatgctggacaagagctcaggagccaggagcacagatacaacaggctgtcacactagccctttgctctcaatggcagaggccagttgactcaacaaaagggcagaggacccactgagctgtaaacaattaagccgtctgcagatgacaaagctaaaggagcattgtaacatggtccctggggctttgggagtcacaagcaccccgcctggatgctgctggaaggcctgcatagagtttgctcctgatggcaaccaaaagtgcttgctctggctcctgcacctgctcacctgcatgctccctcctgtgaggggtgaaacgcagtaggtccaagtgaatggagtttgatcccactggcaccaaggcagcaggctgattccagcactgatgcactcgtattccagttttgcccactcatgtgctccctccgagaaggagatgagtgtggcaggctgagtaaacaaggcacctctcttacaagtcctgcaaaaacatcagggaaatatcctgcttcaatatcatctgcaaacaagaataatttaacttatttcttttcagtctggatgccctttatatctttctcttgtctaattgctctagctaggacttgcagtaccatgatgaatatcagtggtgacagtgggcatctgtgtcatattccagatcttagaggaaaggctatcagttgctccctagtcactatgatactagctgtgggtctgtcatgcacagcttttatatgttcatgtatgttccttctatacacagttttttgagaggttgtcttatgaagagatgttgaatttaatccaatgcttttcaagtatcagttgaaatgatcacatggttcttatccttcgttctgttgatatgatgtatcacattgattgattttcatatgttgaactatccttgcatcccaaagataaatccaactaggtcacaatgaatgatctttctaatgtactgctgaatttaatatgctagtattctgttgaggacttttgtatcaatattcatcagagatattggcttgtagttttttatttcatatgtctttggtcttggtatcagggtaataatggcctcatggaatgagttttgaagtatttcctcctcctctatttttctgaatagtttgaataggattggtattacttttctgtaaatgtctggcagaattcagcggtgaagccatcaggtcctaggtttttctttactggcagatttttttattatggcttcgatctcgctacttgttattggtctgtccaggatttagcttccttcctggttcaatcttgatagattgtatgtatctagaaatttgttcatttcttttggattttccaactaattggcatatagttgctcactaatgatcctttgaatttctgcagtattatagtaatgtctcctttcgcatttctgattttatttatttggatcttctttttttcttagtttgtctggctaaaactttgtcaatttttatttcaaaaaccatgtttttgtttaatttatattttgtgcgatgttcatttcaattttatttcttttccaatctttattattccttttctcctactaaatttggggttgatttgctcttgcttttctagttctttaagatatattattagattgtttatttgaagtttattccccttattgaggtaaacacttataaatttccctcttataaataaaagcatcctaagagggatgcttttgctgtatcacatagggtttggtatgctgtgtttccacttttatttgtttcacaaaatgtttaagtttcctttttaatttcttcattgacccactggttactcaggatcatattgattaatttccatatatttgtacagtttccaaaattctacttgtcattaatttctagatttattctattgtggtcagggaaaatgactgatataatttcaatgttttgaatgttttaagatttgttttgtgacctaacatatgttctatccttgagaataaatgtgctgagaaaaagaatgtgtattctgcaggtcttagatgaaatgttctgtaagtatctattgggtccatttggtctatagtgcaggggtttttgttgtttgttttgagatggagtcttgctctgtcatccaggctggagtgcagtgacatgatctcggctcactgcaacctttgtcccttgggttcaagtgattctcctgcctcagcctcctgagtagctgagattacaggcgcacaccaccatgcctggataccttttttttttttttagtagagacgagcttttaccacgttggccaagttgctcttgaactcctggcctcatgtgatccacccacctcaacctcccaaagtgctgggattacaggtgtgagccaccacacctggccaatagtgcaaattaagtctgatgtttctctgttgattttctgtctggaaaatgtgtccaattctgaattttgggtgttgaagtctctggctattattgtatcagggcctctttctgtctttagctctaataatatttcctttatttatctcagtgttccagtgttgggtgtgcatatattttaaatgattacattctcttgctgaattgatccctttagcattatatagtgactttccttgcctattcttatagtttttgtcttgaaatgtattttgtcttgtataagtatattgaattctgttttttggttgccattggcatggaatatcttttctcatccatttattttcaatctgtgtgattctttataggtgaaatgtatttcttgtaggcagcagatcaatgggtcttgttttttcatccattcagccagtctataacttttaatttgagtttagtctactcaatattattactgataattaaggacttactcttgacattatgttatttgttttctggttgttttgtaatcatctattccctctttctttcattcttgtcttcctctagtgaaggtgattctttgaaagcatttctggacctgccctgggccagaggacaacacactgctctgaagggtgagtccaggccaggcagcatttaccccaaagtgactgaagagacctgggctttaagagaaacttggcactgggcagtaatctggcagtactccccatgggcttgtggtggtggtggccatagagggagactcttctgcctttgaaatgggaaggaaagagtaggaagaactgcatctagtgcttagagtgccagctcagctgcagtacaatagaataccatgtagacttctaaggtttttaatctagctcctggatggcacctccagacttgcctgggttctggagaaagtcaccactccaaagagaaagacacaggcctggctggcctcgctacctgcttgactgtagagccctaggcccttgagcaaacacaggcagtagcaagggagtgattacagcaggtcctgggtgagactcagtgctatgctggtttcagatctgactcagtgccgttatactggtggtggcctcagtagtgcttgtgttactccacacccagcttcaaatggctcagaacagagatatttgtttgggagaagtaaaagaagagaatcagagtctctgcctggtagtccagagaattctcccagatcttgtccaagaccatcaagatggtaccactctgagtctgcaagaaccacggtcttactgggcttggggtgctccctaaagcagatacagtttaaatcacaatacccaagtctttttgaatatatggaaagcctttccaggaagtatggctgcaaacaagcccagtctacaaagactaccataaatacttaactcttcaatgagcagacacagatgaacatctagaagtatcaagacaatccaggaaatcattacttcaccaaagaactaaataaggcaccagggaccaattctggagaaacagagatatgtgacctttcaggcagataattcaaaatagctatttcgaggaaactcaaagaaattcaagataacacagaaaatggattcagaattctatcagataaatttcacaaaaaagattgatacaatgaaaaagaatcaagcaggaattctggagctgaaaaaatacattaggcataatgaggaatgcatcagactctaacagaattcgtcaagaagaagaaagaactagtgagtttgaagacaagctatttgaaaatgcacagtcagaggaggcaaaagaaaaaaaagaattaaaaaaagtgaaccacacctataggatctagaaaataatcttgaaagggaaaatctaagagttattagccttaaagaggaggtagagaaagaaataggggtagaaagtttatttaaagggatattaacagagaacttcccaaacctacagaaatatatcaatatccaagtacaaggaggttaaagaacatcaagcagatttaacacaaagaagactaactcaaggtatttaataatcatactcccaaaggtcaaggataaaaaagaatcctaaaaacagcaagagaaaagaaacaaataacaaacaatggagctccagtgcatctggcagcagacttttcagcagaaaccttacagaaaaggagcaagtggtatgacatatttaaagtactgaaggaaaaaaacaacaacaacttttaccctagaatagtatagctggtgaaaatatccttcaaatatgaaaagaaatcaagatttttctggacaagaaaaagctgaggggtttcatgaacatcaggcctgtcttagaaaaaataataaagatagtacttcagttgaagaaaaggacattaatgaacaataagtaaacatccaaaggtacaaaactcattggttatagtaagtacacagaaaagcacagaatactatgacattgttactgtggtgtgtatactctatactacatagaaatgctaaatgatgaaccaatcaaaaataataactgccacaacttatcaagacgtagacagtaccatatgatataaatagaaacaagaaaaagtttacaagatggagaatgaattaaggtgtagtttttgttttatttttgattgtttacgcaaacagtgttaagttgttatcagcttaaaataatgacttatgagatagtatgtgcaagcctcacagtaacaaaccaaaaaaaaatacaactgctacaaaaaataaaaataaaaagcaagaaactaaatcatttcaccagagagaattacctacacaaagaaagaacagaggaaggaaaaaaagaatgaagagaagaccagaaaataaccagaaaacaaataaaaaatggcagaagtccttacttatcaataacattgagtgtaaaaggactatattctctaatcaaaagacatagactggctgaatgaatgaaaattcaaacccatttatctgttgcctataagaaaaacacttaacctataaagacacacatagaccgaaaataaagggatagaaaaagatattccatgccaatggaaaccaaaaaagagcaggagtcactatacttatagcagaaaaaatagatttcaagacaaaaactataataaaggacaaaggacaacattatatagtgataaaagagtcaattcaggaaggagatataacaattttaagtatatatgcaccaaacactgaacagccaaaaagagacatagattccaatacaataatagttggaaacttcaacaacccactttcataaatggacagatcttccagatggaaaatcaacaaagaaacatcagatttaataactatagtccaaatggacctaatagatatttacagaacataccctctaatggttgcagaatacacattcttttcttcagcacatggattattctcaagattaaatcatatgttaggttataaaacaagtcttaaacattcaaaagtattgaaatattatgaagcatcttctctgaccacatgaaatagaactagaaattaataataagaggaattttggaaactatacaaatacttggaattaaactacataatcctgaatgaccactgagtcaacaaagaaattaacaaggaaattaaaacatcttgtgaaacaaatgataatggaaacaaaatatattaaaccctatgagatacagcaaaagcagtattaagagggaagtttatagctgtaagtgcctacataaaaaaggagaaacaacttcaaataatctaacagtgcatcttaaagaagtagaaaagcaagagcaaaccaaacccaaaactagaagaaaagaaataataaatatcagagaagaaagaaatattaattgaaatgaacaaaacaatacaaaagatcaataaaaatgatgttcttttgaaatgttaaacaaaaattgacaaagcttcagccagacaaactaagggaaaaaagagagaagaccaaaaaaaaaaaaaaaaaaatcagaaattcaaaaggagacattacaattgatacagcaggaattcaaagaattattatggctactgggagcaactataagccaataaattggaagttttagaaaaaaaatggacaaatttctatacacccatataacctaccaaaaccaaaccataaaaaaatccaaaatctgaaaagacaacaagtcaagactgaagctgtaataaaaagactcaataaatggttttggaaaaactggatatccatatgcagaagaatgaacctggacgcctatctctcaccatacaaaaaaaaaatcaaatttgaatggatgaaagacttaaacctaagacctcaaactacaaaactactacaaaaaattggggaaaatatctaggcattcatctgtgcaaaaatttattgagcaataccccataagcacaggcagcaaaagcaaaaatgaacaaattacatcatgactgttaaaatgcttctgcaaactgaagtaaacaattagcaaagtgaagagacagcccacataatggaaggcatatttgcaaactatccttctaacaagagattgataaccataatatgtaaagagctcaaacaaatctatgggaagataatctaataatacaatcaagaaatgggtaaaagatttgaagagacattcctcaaaagaagatatacaaatggcaacaggcatatgaaaaagtactcaacatgaatgataatcagagaaatgtaaatcaaaactgcaatgagatatcatctagccccagttaaaatggcttatatccaaaagacaggcaataacaaatgctggtgaaaatgtggagaaaaggaaatgtttgtacactgttggtggtaatgtaaattagtacaaccactatggagaacagtctgcaggttcctcaaaatactaaaaattgagctaccatataacccagcaatcctactgctggatatatagctaaaagaaaggaaatcactatattgaagcaatatctgcactctcatgttattgctgcactgttcacaatatttaagatttggaagcaacctaagtgtccatcaacagatgaatgaataaagaaaatgtagtacatacatgcaatggaatactattcagccatgaaaaagaatgaaatcctgtcatttgcaacaacatggatggaactagagatcattatgttaagtgaaataagccagacacagaaagacaaaaattacacgttctcccttatttgtgggatctagaaatcaaaacaattgcactcataaacatagggagtaggatagttcccagaggctaggaagggtagtgagggagtggggaagaggtggggattgttcatgtattccaaaaaaatagaataaaaagacctactaatttatagcacaacagggtgactacagtcaatcataatttaattgtatgtcttaaaataactaaaagagtacaattccattatttgtaaaacaataactgtttgagggaattgatatctgattttccatgacgtgactgttacacattgcatgactgtatcaaaacatctcatttagcccataatatatacacctaatatatactcgcaaaatttaataaaatttttaaaaattttaaaataaaatgaaataagcaatgagcaagtttcatcaagtcacagaatcacaagatttttgcttctagagaggaactaagcactatttagttcaatttattcctttcacaagtgaaaaaacctatacttaaatcagagtttgtaaaactatagctcatgggctgaatctagccgcctatgtttttacaaataacacttttttaaacacagccttgtctacttatttgcacattttctaggacttttgttctacagtggtaatgttaagtagtttcaataaagaccatataatccacaaagcctaaaatatttgtttactctctggcctcttcaggaatgtttgccagctgtttcagatagcatgtataatttgcccacaatcacactttaattagtggcaaaatttgtctaaaatctatctttacttagtgatatgctctttctattctatcacattgcctcactgtgtccaatattttagtagtaaaattaaagaccaaattcaaaagtggtaagaaggaagacaataattacaattaaaatggaacttacccagtgccactatacgttaagagctactagttcaacttacctactcagtcttctgcatgccctccagagaaaatgtcacaggtcacatacatttttatgaatatttacccaatgtcacaaatttatcaagctgtaattattttagtggcaataaattaaaataaaatagcaataattagtagtctatactcgtgtaggctacatctatactagaaaataataaaataactctgtagctggaactctcattaaaatatttttgtcttttaatataaacaccaaaactcattattcaataatatccaagtagctgagcaccctcaaagagacaatatactgagaaaaattattaaaattcaaaaactgtaaattagacattcccaatatatagtccctggaccagcaatatcagcatcatcaagggagcttgtttaaaatgcaaattctggggacctacctcagacctactaaatcaaaaattctgggaatgggatgtagtattctctgttttaacaaggtttccaggtgatttttagtcatgcctaaagtctggaaaacactgctctatatcaacataggtaataaagaaacaccctaaagtataaaaagaaaataaattaaaacaggcaaataagcatcattatagataacaacttgcacagcatttatttctagtccctaagccatgttaacaccctaccttacaaacaagtcacttctagtcaacaactaataagagttctagaaactttgccaagtataatcagtaagttaagaccaaatattcataaagaacagaatgatataagcgaattaaaatagtctgcctccaatttgacggctgaagcttttaagctataaccatccctcttcccttattgccttaaacttgggcgaattggtaagaaagcccagtgctccttctgttggcactggtaagaaatttaaaccacataaatcctgctaagacaaaccttgccccagtccacctacctttaccatcataaaaaccccaagccagtctccgttatctgctctttcaagccattctgtgtccattaagagccactctattctctgaaaaacgttcattttctgagtactaaaccttttcatatcttcttggtgcatgtatggcatgaccagtattgaaatctgacccaaactttgcatgcggagagtctatcctgtttccacatggtaatcacaacacaaattcaaaattttttttctcatctactaaaaatatattccaaaagaaaacctgagaagtcctgttataaaatgtaagcttcctctgttgtagctttcacgcaagatgttatatagataacttatgcctttattttaggaacatgatcagaagctatactttttcagcaataaaattctaccaccccaagatcactgtattaaatatttgtgccacagggattgagatattgctacatatacgctataaaagaagaagtaattgttctgataatcataacactaagaaacaactgggagaaaagtagcttcagggacaatattcagtagctaactgttcaactcgctagttcacattgcttgtagacactgagtctagttatggggtaaatcaaagtgaataaaactcagctggaattttgacaccagcagtgtttttctttagtgttgcttcctggaaaaaagttaaaaataatgcaaaatctacaaaatgtcaagggaaaggcaagatagcaaaatggaaactacagacaacacaaattattgtagagcaactcatgctttggatattttggatgtaattttaaactgttaattttaattgaccataaaatccaaaacttcagaagagaaatcgtgtaaaaactgatactgtgatgagaattagacattaacttcaggctttaaatatgataaaaattattttccttacttcttccattgtttttaaaaatacatctgctttgtaattaatgactgtatgttagattcaaggtgaagtactatcattctttctgatgaggtagctgttcaagttttggccataaacaccaaattctgattactaagccccatggtgattgagtgctataaaacatagcagaacacaaagcccagactcttcagacagatgatatatacttctatgaacacccagcagccatgacagttggccagcaacttcatatttgaacagcataaccatttatcatggaagaatttaatctaaacattaaattattcttttactctttgattaaatgaaatcacaaaaacaaatacagtttgattaaagataattcaaccaagtgcctattaagatgaattcactgtcaatgagctagatgtgacaaaatttagttataaaattataatagctgaggcttacatatttaaaatcggcagaatcactgagaatcattggttaattcaggcttgtttctaaattatccagaaacctggggaaaggatcagacaatgagatctgtactatgtatgtcactcatgaagtttctaacaggcaagctttgtgacattgtgaacacatatacaacttaacagtatttaaactgttatttgttctaaaatattccatcaaaaatcaggttgtgaagaattattaaacagaaaattgagaaagtgaagttaaagaggtctgaggtaggccgggcacggtggctcaagcctgtaattccagcactttgggaggctgaggctcgcagatcacgaggtcaggagatcaagaccgtcctggctaacgctgtgaaacccgtctctactaaaaatacaaaaaattagccaggcgtggtggcgggcgcctgtagtcccagctactcgggaggctgaagcaggagaatggtgtgaacccgggaggtggaccttgcagtaagccgagatggtgccactgcactccagcctgagcaaaacagctagactccgtctcaaaaataaataataataaaaaataaaataaaataaagcgatctgagtaaagacggcactgtcaaaaacacagaggacttctttttcttaacaagaaaaagaaaacaagagaagctgcttcaaaggactcaggatattgtttacaattatactagagttttgctttagaaggaagctcttagcagaattaaatgagacccttaacaactgcttgatgtctagttatacaagaaagtacatagcaggcctaatttaaccaaaatgaaagagaagtaatttacctctcatttacttgataagctaacaaagatattatttgagcattgctgttgttgtagttcagacaattatggctagaggagaccagaaaattaccctatttcttaattcttttaaatataacaatctatatacaaatgtgtatgtataggaataacttactttgatgttttattctgctttctatattgcttctgaagcaattatttctttgttttaccaatttgtttactggtatcagacttttatgctggagacttccctcaaaatctcaagttctctttgccttttaatttattcttaagaaattaaggtactgaggaaattactggaagctttctttgcagataatttcactgagaatcactgggcaaataaattactatttcattggagaatctctacatatcattgttcttttatggtaagttaattcaaagaggaatcttttacttctcttccagatgctgagtggcagaatgccagtaatctgggagctaaactggggaaggtcactgtgttaggccatttgcattgctataaagaagtacctgagacttggtaatttataaataaaaggagtgtatttggcttagggttctgcaagctgttcaagaagcatagaggcagcatctgcctcttttgagggcttcaagaagcttctatgcatggcagaaggggaaagggagccagtgtgtgcagataatatggtgaaagagaaacaagagaggacagagggtagtgccaaactctttttaacaatcagatcttacagaaactaatagagtgaaaaggctcattaccaccaaaatggcatcaagccgtgcatgagggatctagccccatgacccaaatacctttcatcaggctccaccttcagttttgcagctctactttcaaacaggagatttagagaggacaaatgttcaaattaggttagtcacagtttaactgggatctttagacaatccccttattaactgtgcgcttgttccctctattgtctggcattcgtgaatgtggagcatcctttcttggatagctccaggaggtaaaatccccagggtcccctccacctcaggaaagagagggttttgtgagggtatctggggtgtcttaccgcttcttataaaatttaatccaggactctagtgttaagttgctctcttcaaggtacttagtgcctccaattctctccatagcattagttagcttgtttctttttccctaagacttgcactctgccaattctgattttatttatccatctactctgcatttttcaaaagttctcaattgctctctcttcctccatttattttgtttttgtgagtttagaattttttaatttatctagtttcagtgtagtgggttttgagaaacaatataggtaaagacacatattcaaccttccaagttaagtggaaattaccacattcccttctattccttagcttttgtctcccacccattggtgtcattcttcagtcactttgccaaactgactaaacccaaaccactttccatctcttaatttttacttattttatttctttcaccttcacctgaaggtctttttccctttggaagagtatttcttcacatgcattattattctgttcgcacttcaaagtaaaatcatatctaacacttggtgaaagtcactcatctgcccatcttgaattattttctctttctcctgtatttgtatcatctccaattttgcttgttataaaatcaatattattctgcctcaacttaagctcccttttcccccaggttttattctacttaaaagttaagacttactaatctcagtcacctccacatagtccgaatagcataacatctatagtacagttatttaaatgcatatttgttgaattaaaacaaattgaactctaacactttatgagaagatgctatatttcttctgctccttcatttttatttcttttcacttctttctaggagctaaaagtttaaacactgttatccagtattagaactgagaatcacatatccatttcactctctctttctctgtctctgtgtgcatttaaatattttttcaatggtttttggggtacaagtggtttttgttgtatggatgaattatatagtggtgaattattagattttagtgcaccaattacccaggtagtatacatcgtacctaatgtgtagtttttttattcatggcccttctcctaccctcccctttctgagtctctaaggtccatcatatcacctgtatgcctttgcatactcacagcttagctcccactcgtaagtgagaatatatggttttgggttttccattcctgtgttacttcacttagaacaatggcctccagctccatccaaattgctgcaaaagacattattttattccttttaatggctgagtagtattccacagagtgtgtgtgtgtgtgtgtgtgtgtctgtgtgtatgtatatatatatatatatatatatatcacatttttattattcactcattagtcaatgggcacttaagctggttcgacatcttttcactgtgacttgtactactataaacatatgtgtgtgaatgtctttttcacataatgacatatttttctttgggtagatacccagtagtgggactgatggatcaaatgatagatcttcttttagctttttaaggaatagccatactgtttaccatggaggctgtactaatttacattaatttacattcccacaagcagtgtataaccattaccttttctccacatccatgccaacatctatcatcttttgacttaataatgaccattcttgtaggaataagatattatttcattgtggttttaatttgcacttccctgttgattactgatattgagcattttttcatgtttgccatttgtttatcaacttttaagaactgtctattcatgtcctttctccactttttaaagggatttttttcttgttgatttgtttgaatcccttgtatattctggacactagtcctttgtcagatgcatagtttgcaaatattttctcccactctgtggatggtctgtttactctgctgattatttcttttgctgtgcagagcattttagcttaattaggtcccatttatttatttctgtttttgttgcatttgctttgggggtcttagtatactgtgagagagagggattctgtttcatccttctacatgtggcttgccagttttcccagcaccattaaatacggtgtccatttccaatatgcgttttgtatgctttgttgaagatcagttggttatacatatgtggctttatttctgggttctttattctgttgcactggtctatgtgactacttttataccagtgccatgctcttttggtaactatagccttgtagtataatttgaagtcagctaatgtgatacctccagatttgttctttttgcttagaattccttgggctattcatgctcttttttggttccatatgaattttaagatttttttttgctaattctgttaaaaaacaatgttggtattttgatgggaattgcactgaatatatagattgtttttggcagtatggtcattttcacaatattggttcttccaatacatgagcatggaatgtatttccatttatttgtttcatctatgatttctttcagcagtgttgtgtagttctccttgtagagatctttcacctccttggttaaatatattcctaggtaattaagcttttactaataaataaaagtaacctaacttgtgcattgcactctttggagttgagaaaaccacgtaattagtggttttaaaactggctttaactgacagcgtaataggggaaataagacttaaacacatgaaacaatttataattcaaggcagtataaaataaagagtgagggccaggcgtggtggctcaggcctgtaatcccagcactttgggaggccgaggtgggtggatcacgaggtcaggagatcaagaccatcctggctaacacggtgaaaccctgtctctactaaaaatacaaaaaattagccgggcgtggtggctggagcctgtagtcccagctactcgggaggctgaggcaggagaatggcgtgaatccgggaggcggagcttgcagtgagcagagatcgccccactgcactccagcctgggcgacagagcgagactctgtctcaaaaaataaataaataaaataaaatagttagattgtgggttctgtgacagcccagataaacagtgaaaattatatgggtataatcctttttgcagaatgggtaagaatctaaaggaaatagaagaaaaaagggaaaatgtaagtgaaaacaaaatatttgaaaacctagaaaaactctgggactttatagggagatttgtctgacttaagtaacagtaggccaattctggagagttgtggagaaatatgaatctgctaagaatataaatatgaatagcttgaaaacagaggcatcataaaaaaggagacaaggagcttctaatcaggcaagtatgacattgaaattagaaaatttacatcaaggctcctaaataatggctatgatggggggatggtaactggaaaccagaatcagcccagaaattccagattatacattcttaatcccaaaaagacaatactgatgggacaatcaagaacaggaatgagagggaaagtcttctagatagtgttcagtttatctctggttttcaattgcttttttcaactcgttttgttgttgttgctgctgtcgttgttaaggggccatatgctcaagttgcttgctgaagttgtgatgaggttctttctacaggatgtgctcaacaaggtaagtttaaggaaggttaaaggaacataactctcaagtgataaagtactaggtactaattctaaatgaaaaaaggagatggcatctcaggtgagaacacacttccagtgttagatgaagtactagttaagagacaagatgggataatctcttgtgcttaaattctattttttaaaaaatttactttctttttgccctttttaatgtaatatttttaatttccaaattaaatggtatatatttaatgtgaaatttttttcaaatttaggctattaagaatccagagatacatgtcttaatcaatcttcgtatcttattaacaggagtaattttttttccttaacatacattgccttataaatgggtgattatctagcccatgggaagaagccaggtaggtgctgactatagcatatgtctctcatatgcctgctgcttcttgaaattctagaaactcagatattttcccagttttaaggcactaccttttgtttcagtgaagatggtctgggagatgaagtacatttcaatctgacttttactggaaatgtctaagggtaggtctttttggagtgcaagttttgataggagaatgatgatgaaagaaaacagaagtggctgggggcttgggagttggaaaatgcatctaaaggagggaaaaacactacattaactagaatgacagcaatatttctgccaaagaccaactttcttcaatttgcaattccatataggttcagtcagaggtaaaatacaaacccagctattagcctaggatgattggtagcatttttataaggacatatcttgaaacagaaaattcacaactattatttttatcattttttttcttatcactcttgacttcaatttgataatagtcatgtaagcattccaggagctactgggctaaagtacctcctgataacatccccactgtctcggggattagcgatcatgggtgacccgttaagaatgagacattgtgtcaattccaaagttcaagtagagcttcacctctaaatctattttagataattcttttgatagttagaatataatatatcttgagatcactgcttttaattaatgattacccctctgcctttatcttaattccctttatcttcatcagtgaaagagtcacactgtggcaatgagggttgttgggctggaggtcagaatcaagtgaaacttatttcatctttagtttgaaattacatttctttaaatactgctccaggggaaaatcaatgggtataaacagaaaatgctcaagtatgagaaaaatagacttcaaggtgaaatctttaaaatatatggctcaggaagaaaaagcagccaaaaggcatgtatttctgctactggggactgaaaaagatgagccataaagtgtaatcgttttatattaacaacttccatcttctcacattcataattgcttttagctaatgcaaaagtgaagatcttaatattatccgacatttgtttgggtgaatgggaaaatgtgatctaacaaaagagtaacacaggatacaataaagcactactttagaaacagcagcaagagttatatattccaacagtgctgggtcccatgatccttaatttgcatataaataattaatatgcataccccaataatgccagcttctgtgcactacatttagtatgaattatgcagaaatgcttcagaaatgcctttaatagtaaagggaattgctaccctccaagatatgtaggaaataaaatcatttgtttgaaacataaaatgaaaacagaagatctgattaaaaaacattcaggaaaggcaagtttcttgatcaactatctttttttttgagacagagtctcgctctgtcacccacgctggagtgcagtggtgcaatcttggatcactgcaagctccacctcccaggttcacaccattctcgtgcctcagcctcccaagtagctgggactacaggcacccgccaccacgctcggctaattttttgtatttttagtaaagacggggtttcaccaggttagccaggatggtctcgatctcctgacctcatgatccacccgcctcagccacccaaagtgctgggattacaggcatgagccactgcgcccagcccaactatcttgtgttttatgtgtgttttatcttttaggatttgtactagccttcaggaatatgaaagtgcatatgagtccttagaaaaagaacatagtgaaatcacacaaataaaactgctgaacaattaggaagtagtaaagggcaagccctgagagttacacagctccctagaggggacacttgaagaaagagttgagtaccccaagggagagatatatgtatttttttaatgttgtatgtcagagcacagaaagagagatttaatatgtatttggaagatttgttggttaagagaatctatgcaggctatgcttatgatcacaaaaacgtcaacataagacaatactagggttactcccacggctaagccaacatgtcaaaaagttttcacctaatgttaggaataattgctcctgataatcaacttggcccagaactgagaaagaggcattcaagtgctaactgaggttcaacgaaatcatttcactggtggagtttcatgggaccaatgtcaatggcccccatgaactgctcattgctctgaagttttgaagacataagattccttgaattacctcagttttgttctctcatacttttgcattccagtaggtgggtttgatgaaacccagccctgctggtctttaagaatattcaggaagatagtcaattaacaacatacattcttgctggaacataaaactagttaaattaagctgcagataatttagaagagtctaggcaatatagcttagttaattgagggggctctagagacagattgcctggatttaaattctgaaaccacaatttactaaatcatgactttgagcaacttgctcaaacttcatttaccttagtttcctcatctataaaatagttatgataatactacctagagccttcataaagtcattgtaatgattgaaggagtaaatacatgtaagtcacttagaatagaaccagcaaataataatagcgctataaatcttagccaaaattattgtatcataaagattcagagtttgagctctggagtcatactgctactttgatttcacttcttactgagaaatgaaagttctaacccagctcctattgcagtagcacctactgcaaaggtcattatgtataacgattagcaaaatgctcagttctcaacgtgtcagcagttaaaaaagccatccctgttattcttgatattttataagattttcaaacactattataaaatcagatgctttagtttatggacataatagtgacaaaacattattcagagaaatagtgagtatcttatacatttttacctaattcttgaaatggcctcttagcctgcagactttgaagtttttcagaagccagggagaggggacagaggagaagctactttattacattgagtgataaattatactcgttttcagcatgcagaactaaattttcatagtataaaaaaatgtctagccagaagctttgtctgcatgaccatacaattgggaaaatatatatttattaataaagtatatataaatatgaagagacagttattgtccttagagtaaccgtgtgtttgtttcaatgaaagcaaatatttacaacatttgctgtaaataatgtaccttgacagacatacaaaataatgtgacacttcctcctttctactgtattaaggatcaagcttagttgatccataccaattatgcctggatatagcttgccaaaaatagatcgattttaacatatggagagaaaaatcaaattataaatgtgttcttccaagttttatctagtgaatcaagtgaatctagtaataaatgaggtaccagtaagtgattcgtacaaccaagatcgattccactatgtcctgagcatgtaaaaagtttcattaaaattaggaagagctgtttttttaaaaaaaattgtttatttttatgaatttaggggtaccggtgcagtgatgttactgagacacattgcacagtggtgtaatctgggcttttagtgtacctatcacataaattgtatacattgtacctaaaagatagtatttcatccctctcctcactcccttcttcttatgagttggaatctccagtgtcttttatttcactctgtgtctgtgtgtacccatcgtttagctcccatttataaaatgagaacatgtagttttaaactttctgttcctgagtcatttcactaagaataatagcctctagttccatccatgttgctgcaaaagacatgaattcaggctttttcatgtctgagtagtatgccatgatgtatatataccaaattttatttaactttttggttcaggggtacatacatgtgcaggtttgttatatagatatattgtgtgtcatggggctttggcatacagattatttcatcacctgggtaataagcacagtacctgataggtaggtgtatgatcccttccctcctccaaaccttcacactctatccacaaataggcctcagtgtctgttgctcccttctttgtgtccatgtgttctcaatgtttagcttccacttataagtgagaacatacagtatttggttttctgttcctgtgttacttaggatagtggcctccagcttcatccatattgctgcaaaggacatgatcttattattttttatggctgcatggtatttcatggtttacaggtaccacgttttctttattcagcttatcattgatgggcatttaggttgatttcatgtccttgctactgtgaatagtgctgcaatgaacatacatgtgtatgtgtctttatgatagaatgatctatattcctttgggtatatccccaataatgagattcctgggttgaatggtagttctgcttttagttctttgagaaattgctgcactgctttctacaatggttgaactgatttataatcccaacaacagtatataaatgttcccttttctccacaaccttaccaacatctgttatttttttagtttttaataatagccactctgactggtgcgagatggtatctcattgtggttttaatttacatttctctaataatcagtgatactgagctttttttcatatgcttgttggccacatatttgtcttcttttgaaaagtgtctgttcatgtcctttgctcactttttaattaggttttttttcttgtaaatctgtttaagttccttacagatgctagatattagacctttcacagttgtatagtgcaaacattttctgattttgtaggatgcctgtttactttgttgctagtctgctgtgcagaagctctttagtctaattagatcccattcatcaatttttgcttccattgcaattgcttttggcatcttcatcataaaatcttcacctgttcctatgtcaagaatggtatcacctaggttgtcttcccgggttttatagtttttagtttttgtttaagtctttaattcatcttgagttggtttgtgtggtgtaaggaaggggtccagcttcaatattctacatttggccagccagtcatctcagcactatttattgactaaggagtcctttttctactgcttgttttcatcaactttgtcaaaaattagatggctgtaggtgtgcagctttatttctgggatctctactttgttccattggtctatgtgactgtttttgtaccaataccatgctgtttaggttactgtagacttgtagtatagtttgaagtacggtaatgtgatgcctccagctttgttctttttgcttgagattgccttggctatttttttggttccttatgaattttaaaatagttttttctaatgtggtaaagaatgtcattagtagcttgataggaatagcattaaatctgcaaatggctttggatagtatgatcattctaataatattgattattcctatccatgaacatggagtgttttttcatttttctgtatcctctctgatttctttgagcagtgttttgtaattctcatagtagagatagttcacctccttggttatctgtattcctagttatttcatttattctatggctattgtgactgggattatattcttgagttagcattcaacttggacattgttggtgtatagaaatgctactggttttgtacattgattttgtaatctgaaactttgcctgacatgtttcgacatgtttatcatacctaggaacctctggggagagactagtgttttccaggtaagaatcatattgtcttgaggagaaatagcttgacttcctctctttctatttgaatgccttttctctctttctcttgtcggatttctctggcgaggacttccaaaactatgttgaatgaagtgttgaaaaagggcatccttgtcttgttcttattctcaagaggagtgcttccagctttcaccctttcagtatgatgttggctgtgggtctgtcatagatgtctctcattattttgagttatgttacctcaacgcctagtttgttgagggtttttaacataacagaatgctgaatttggtcagaaggtttttctgcatctactaagatgaacatgtggtttttggttctagttcagtttatgtggtgaatcacacttattgattagcatatgttgaaccaatcttgcatctcaggattaaagtcaacttgattgtggtgttttagctttttgaaatgctgctggatttggtttgctagtattttgttgaggattttcctgtcaatggtcatgaaggatattggctttaagttttccttttttattgtgtctcttccagcttttggtatcacaataatgctggcctcatagaatgagttagggaggagtccctcctcctcaatgttgtgaaatactttcagtaggaatggcagcagatcttctttataactctggtaggatttggtcatgaatccatctgctccttggatttttctgcttggtaggcattttattactgattcaaccttggaactcattatttgtccgttcagggattcaatttcttcctggttcaatcttgaaggttgttatgtttccaggaatttatttacttcttgtagcttttctagtttgagtgcatagtggtgtttgtggtagcctctgagtttttgtatgtcccttagtcatttttgattgtgttcatttggatcttctctcttttttgctttattaatctagctagcagtctaccaatcttacttattcttccaaataaccaactcctctatactttggtcttttgtatggtttttcacatttcaattttcttcagttcagctctgattttggttatttcttcctctatctttggggttggttttctctttgttttctagttcttctaagtgtgattttagatggttaatttgagatattttttcatttttaatgtggtatttaatgctagaaactttcttaacactgctttaactgtgtcccagattcttctatgttgtatcttcgtcttcattcatttaaaaaaaaatttaatttctgccttaatttcactgtttactcaataaacagggatttttattccaaaaaaaattcaggagcatgttgcttaatttccatgtgatcgtatagttttgagtgttttcttagaatagatttctatttttattgtgctgtgatctgacagtgtgtttggtataatcgtgtttttttccaatttgctgaggatggttttaggtctgattgtctggtcaattttagagtatgtattatgtgcagatgagacaaatgtatactctgctgttttgtggtagagagttcagtagatacctgtcaggcccgtttagtcaagcgtcaagttcaagtcctatttatctgttagttttctgcctcaataatatgtatagtactgtcagtggagtgttgaaatctcccactattattgtatggttatctaagtctcttcggagatctctaaaaacttcctctacaaatctggatgctgctgtgttgggtgcatacatatttaagatagttaggtcttcttgttaaatggattcctttaccattatgtaatgccctttttgtctttttaaaatctttgggctaaagtgtatttttttctgaaaatagaatagcaatgctggcatttttcttttcttttcatcacctatattcagcgagaaggtcacactgcacaatgagaaacacgcgggggagacagcggccctcgaggaggccatgaaaggtctaagcctgatgcggccccacggctccagctccagaaatatcagtatccgcaactgggcccaagcggggccagtactatgccgggtccctgctcaacgtgaaccagatcgggagtggcaccgtggacctgcccttccagacccccttccaatccttgggcctggacaccagcctgactaccaggcaccatgggctggtgaacagggtgtaccgggaatgcggccgactaggctccccgcactgcctgcacctgtcaaaggacaaacacggacagcaggccaacagctgcccatacggcaccgtgtacctcttgccacccacggacaccagctggagaaggaccaattctgactcgccctgcgccagagcacaatgacgcccatgcagccagaatcctttactagtgggtcccaggacgtgcaccagaaaaaagtcttactgttaacagtcccaggaatggaagagaccatatcagaggcagacaaaaacctttccaagcaagcgtggggaaaccaagaagacgggatccaggaccaagtcctgcgcggaatcaacgaatcaacatcttcccgtccgccgaccaggaaaacactacagccctgatctccgccattcacaatactgtgggctccctgcaccgcctgaccaacatccacttcccttccccgctcgactccgaggagcccaccttccccgcactcagtagctccagcagcaccgacaacgtctcggccaacctgatgcacctgggcatcagcggcgccggccaaggggatgagtacactcggctcccctccgcagcaccgtccagccggcgtcagccccctgtcccgagcacagagacgaggcatcagcagtcatcgcccactctgtccccgctgtcatacatcactcaggccgtggccttgaatgccctgtctctggagcagcaggtaccctacgccttcttcacccagacggactcccagcagccgctgccgcagccccagcctccgccgcccccttagcctgggtctcagcagccgccaaccccaccgcccctacaggcgcccgtccgcctgccccccggcagcccctgttgcccagcaccaacctgaatcgtgggccacagccgcccccgctcgcggtcacggtaccgtcctctctcttccagtccccacgaagaatcccggcctgccgtcgatggggatcgacatcgcctcggcgccgcctctgcagcagtagcggcactagccccggctcctcggccaaccagtctcccacctcgccagtctccaatcaaggcttctccccagggagctccccgcaacacacttccactctgggcagcgtgtttggggacgcgtactatgagcagcagatggcgttcaggcaggccaatgctctgtcccaccagctggagcagttcaacacgatggagaacgccatcagctccctatacaacaggggctccacgctcaactactcgcaggcggtcatgatagccctcacccacagccacgggagcctgctgaactcgcagcagctgggctacaccagccacagtggcatccccaacatcatcctcatagtgacaggacagtctcccccggccccccagcctctttaaagaactgaccagctctctggtcagggtcggcgacctcagcttcgactccgacagccagtttcccctggatgaactcaagatcgaccccctgaccctggacggacagaccctgaacggactgcacatgctcaatgaccccgacgtggttctggcggacccagccaccaagaacaccttccgaatggaccgcctgtgagcgggcatgccggcaccctgccgctcagccatcccgacggcgcctccccagcccggggacagccacgctctgtccctctccaatagccgagcttgtgattctgagcttccaatgccgccaagcgcccccagcccgcccccggttgtccacctcccgcgaagcccagtcgctaggccgcgagccgggcgtccacccactcgccggcccgggctgagctgggatcggagggtgtgaggcccccgcccccgcagaccctccctgtaccgactccctagctcgaagccccgccggggcctaagccgtccgctgtaagatgcgggaagtatcagctccaagcctggcgagcaggctcaggggaggggcgcgcatggtccgccaccatgcattttccgactgtttgtccagctcttactgccttcctcggttcctggtcccccaacctatctgccacccccagcccgtggtcaggtagagactgagtcccaagccgccccagggaggaggcggcagagcgcggagcagacgcaaagtgaaataaacacaattttgaaggcaaaattatatatatatgctgaatatacaccccctatctcttctggcttgtagggcttgtgctgaaagatccactatcagcttgatgagtttccctttgtaggtgacctgccccttctctctaactggcttcaatttttttttctttcatgcctgtcttggaaatctaatcatcgtgtgccttgggaatggtcatcttgtatagtattttgcaggagttctctgcattttttaatttaaagttggcctcgctagtgaggttggggaaaattttcatagataatatcctcaaatatgttttccaagttgcttcttttttctccctctttttcaaggatgctaatgttgtagagttgtagatttggtctctttacacaagcctatatttctcagaatttttgttcattctttttcttcctttattttcatctgctgagttagcctagagaactagtctttgagctctgagattctttcctcaacttgatctattctactgtgtttttgttttgctttgtttttgagatggagtctcactctgttgccaagctggagtgcagtggcgcaatctcagctcactgcaacctgcgcctcctgggttcaagcgattctcctgcctcagcctcccgagtagctgggattacaggcatacgccaccatgcccagctaatttttgtatttttagtagagactgggtttcactatgttcgccaggatggtctcgatcccttgacctcgtgatccacccgcctcggcctcccaaagtgctgggattacaggcgtgagccactgcgcctggcctattctactgttaatacttgtgattatattataaaattattatagggtatttttccgccctatcagatcagtttgcctcttgcttacaatggcaattttgtctttcaggtcctgtattattttactgtaatcctagattccttggattaaattttgactttctcctgaatctcaatgatctttgtccttaccaatattctgaattctatgtctgtcatttcaacctgcttaagatccttactggagaactagcgtggtcatttggaggataaaagacactctggctttttgagtttccagagttcttgcactggttctttctcatctgtgtaaactaatgttcttttaactgtattgcaatttgagtacaatcagttgcttccttttctgggtgttttcacagggctgaggctttgtgcagggcctatatttgtagctgaattctttcacagaggcatatatttgcaaagactttacgaaatttttttcaattattcatgaatggacacaagttgattctataatttttctattgtacatagtgctgctatgaactaatgagtgcaagtgtcttttttacatgatgatttatttctctttgggtagattccaatagtggggttgctagatcaaagattaattctatttctacttctttgagaaatctccatactgttttccaaacaggtggtactcatttacattcccatcaacagtgtataagctttcccttttctccacatccttgtcagcatctgttgtttcttcactttttagtaatagtccttctggttaagatggtatctcactgtggttctaatatccatttctcttatgattagcaatgctgagcatttttcatatgtgtattggctgcttttatgtcatcttttgaacaatttctgttcatgtcctttgcctactttttgatgggtgtttttttgttgagttccttgtagattctgggaattagtaccttctcagatgcatagtttgcaaatattttttgatggttttttttgttgttgttgcgttccttgtagattctgggaattagtactttctcagatgcatagtttggaaatattttctcccattctgtagatagtctgtttactcagttgattacttcttttataattttctgctgtgcagaagatttttagttttagtctcatttgcctatttttgtttttgttgcattttcttttgaaaattcagtcctaaattatttgcctagaacaatgggcaaaagatcttcttgggtttttataacttcaagtctaacatttaatccatatgagttaatttttgaatatggtgagagatacaggtctagttttatttacctgcatatggctcagcagttatcccagcaccacttattgaattaggtttcctttccccagtgtatatttttgctggctttgtaaaagatcatttcgttttagatatgtggctttatttctgggttctctactctgttccatttatctgtgtgtctatttttatactagtatcatggtgtttttgttactatagctttgtagtataatttgatgtcaggtaatgtgatacctgtagctttattctttttgcttaggatagcgatggctatttggaccctttttcatttccatgtaaatttaattttttttctatttatcaaagaatgatagtagtttgacagaaattgcattgaatctatggattgctttgggcagtatggtcactttaatgatactgattcttccaatccatgagcatcactgtttttccatttgtgtcatctattgtttcccgtatcagtgttttatagttctccttgtagagatctttcacctccctagttaaatgcattcctatgcattttttatttgttttgtgtagctattgtaaatgggattgagttcttgatttggttcccagcttgatgattattggcatatagaaacacaactgatttttgtaagttgattttgtagcctgattctttactgaagtcacttataaaatctaggaggcatttggaggagtccttagggtttctaggtataaaattgtatcatcagtgaacagagataatttgacttcctctttgccaatttagatgtcttttatttctttcttttgtctgattactctgactaggacttcaagtactatgttgaataagagtgaagagagtggacatcattgtccttttcccagttcttaagaggaatgcttttaatttttcccattccagtgtcatgttttctatgggtttgtcatatatggcttttattattttgagttatgttctttctgtgcctagcatagcaaaggtttttcattaggaagtgatgctgaattttatcaaatgctttttctgtatctatttatataatcatatgcttttgttttgaattctgtttatgtggtgaatcatatttattaatatgcatatgtaaaaccaaactttcatccctataacaaaatccacttagtaacagtatattatctttttgatgtgttgttggtttctgtttactagtattttgttgaggattttcacatctatgttcaccaaagatattggtctgtagttttcctttttttgtagtgtctttgcctggcattagtatcaaggcaatgctggctttataaaatgagttagggaagattttctctcctcaatttttgggaacagttttagcaagtttagtatcactacttcattgtgtatctggtagaatttgtctctgaaactacctggtcctaggctttttttttattattaagatttttttattaccaatttactttcactactcattattggtctgttcaggatgtctacgtcttcctgattcaatcttgggaggctgtatctttccaggaatttatccattttctctagactttctagtttgtgtacatagagatgctcatagtagtctctgatgatcttttatatttttgttgtatcagttgtaatgacatctttatcatttctgattgtgcttatttgaatcttctctctttatttcttggtaaatctagctactggtctatcagttttatcttttcaaagaacatattttacatttcaatgatttttttttttttggtctccatttcatttagttcagctctgatctttgttatttcatttcttctgctagctttgaatatggtttgttcttgtttacttcattaacatgcaacattaggttgttaatttgagttatttctatatttttgatgtagacatttaagggtataaagttcccgcttagcactgctttagctgtatcccagaagtttttgtatattgtgtctgtattttcatttgtttccaaaaacattttggtgtccactttaatgtcatcattgactcaacaattattcaggagcagattatttaattttcatgtatttgtgtggttttcagcattcctcttggtgttgacttctagttttattccattgtggtaagataatgtacttgatataatttcaattttttcaaatttatcacgacttgccttgtggcatagtatatggtcaatttttgagaatgtcctatgcacagacaagaagcatgtatattctcaggtttttgggtagaatattctgtaaatatcttttaggttcatttgttctagagtccaatttaaatccagagtttctttgttacttttctacatggataatctgtctaatgttgtcagtggagtattcaaatcctccactattattgtgttagtgtctatcacttttcttaagcctagtagtatttggtttatgaatatgaatgcatatatatttagaattgttatatattcttattgaattgatccctttatcattatatgattaccttcttcacctttttttttttttttactgttgttgatttaaagtctattttatctaagtatagttactcctgtcacttatggtttctctttgcatgaaatatatttttgcacccttttactttgagtctgtaaataggtgggtttttttaatgcaacaaaggattgggtattggcctttatccattatacatatccagcatatatcttttaagtgaagcatttagtcaatttatgtttaaggttactattgatatgtgaccttttgtcatacaatgttaatgttcatacttttcatttttcataatgttaatttttatctaattacttttcaatcttgattgtgtaattgatttataagacctgggagttttatacttttgtatgttttttgatgtcaagtattactattttgtccatgtttagaatttctttgagcatttcttgtagtttcagtttagtggtgaaaaattctctaagtgtttgcttgtctggaaaagactctttttttaaaaaaaatttttgaagcttagtttgacaagatactaaattattgggcagcatttttttttttctttaagaagactgaaaataagacccagtcttttctggcttgtaaagttttagctgagaattcttctattagtctgttgggattcgctttataggtgattagatgcttctctcttgccacttttatattttttttcttcacatcacctttggataatctgttgactatatgcctccatgaggttcttaatgcaatgcatttttcaggagttcactgaacttcttacacctggataactagatctctagtaagacctgggaacttttcctgaattcgtctctcaaacagtgtttcatactttatactttttcttcttctccctctagaatagcttaacttgtagttcttggtgctttacataatcccgtacttctccgagattttattcgttttttaaaaatctttttttatttttatttttgtcttatgaggttaatatgaagagctgtgttccagctctaaagttcattattcttcttggtcagggctatttttgaagtttttaactgtattttgtaattccctcaatgaatttttcacttgcagaacttctattttattatttaaaataataactgtctcttcttttatatcccaaattgtgtttttttttctaatttatatgtgttgtttttcaactttctctttaatatcattgagcttctttaaagttaatattttgaattctttatctggtatttccaaaatttaattttggttaggattcattgcaggaaagttagtgtgatcttaagacggtgttgtgacaatctgtttttcatactgtcagaattgtttctctggtttcttctcatttaaataagccatctctccttatttttgaatttattttcttttggatagtatttctcccctccgtgaccccaaggatgtgactaaaatgcatgttgtgtagggtcctttagctttggttctgggtgctttcagtggcaaagactctctataggttcctttgttatatgtggcatttgtatagtgagtgtatttctcagatgctggttgtagtagcaatatactagatgtgtgagtgggctcactgcctcgtgtaggccagtatggcagaggtgtctggaagcttatttctcagtgctgtgcacttgtgccagcagattttgtattgggttgtgcagttcattctctaggccaatgggtgcttcatatggataagagccagctgtggccaatgcagataggtatatacttgatcttagtttactgtgagatgctgtctgttgcgtcaagcaattagctatcccatacaattcacagtcatctgtgctccctgctcgttcctggagagagaaaacaagctgggtggaactagactgggcaagtccatctatacatcccctaatggcaggtataagcactagctttgtgggggtgtctggaaggcagtagccaagtggcaagagatgtccctgggcatggagtagagaaatatccactgcctcaagttctctgcctggaaatggatgggcagcccatactcataatctaagatatgggtgcttcaaatgcctggagatacattcagccatggagcagagggggcgctgccacaccagaatcttggcacctgaaaggaggggtggctcaggctgagcaggtgcactgaatgcctggaaatatgccctggtgtgaagtgtagaggttggtgctgcatcaggatctctgcatgagaaataaggggtgggtcaggctcctatatcaggtgagtaagtgtgacaaaggtctgataatatgcctgggtatggggtagagacagtgcaactgtgtcaaaatttctgcacaggaaaggaggtgtgactcaggttcctaatccaggcaagggagtgggctgaaagctcaaaattatgcccagttatgaagcagtgaagacagcgaagacaccacagcatcaaaatctctctgcaggaaaggaaggacaactcaggctcctatccacatgagttgatgtattgagtgcttgtaattatgcctgagtgtgaggtgaaaagggcaatgctgcaccacggtctgtgcacagaaagagaggcatggctcaggtctccattctaggccacttggtaggccaaatgctggaaatatgttccccagaaagaagcagagtaatttctgtgaagcagagtagctgctgctgcaacaaggtctttgcaggggaagggaaggtagtctcaggggtggggtctgcctccctacacttctcaaaacttgtggggcacactgtcctgactgaccaaaggaactgactacccagcaatgacactagtcccagactgcaaagctcttctggccacacaaatcatgccacccggagaagcagtggcttcagcaattcctctgctccagtcacagtgcctactgctggggtgcagtctacactcatcactcagttctgattgtgggtacccttcccctgctccagagtaagtgctccattctccagccagagtccaaagtccctgtggcagctgcccctgctgggtcaccaaaaattactgacttctttatatgaaactagattgaaaacagtgtcctctcagtccaagtctgggaaaatttccgcagcttttctggcatctttccctcataccctctcccagcctctccccaagttagctccagggcttcggagaaacaaggtgctctcccgtggccttggttggacgaatctctagttaaaaagtgaatcataaatgaaaagtgcctcttttatgcactgaggcttcactcacttttatcagtcaaatgctgtcacacaggctgcttgtaaaccttctcttccccagtatccggagtgtccctcactttttgggtgaattctgtattccttcttgagtaaaagctcacagtgttgctgtttatacaccattttgttatttccaagtgaatgaagcatgctaaaagcctctaatccaccatcttgggaaagaaaaaaaaacaagaagagctttaataaaaaaggattggtcggccagatgcggtagctcaggtctgtaattccagcactttgggaggccgaggcgggtagatcttgaggtcaggagatcgacaccatcctgactaacacggtgaaaccccgtctctactgaaaatacagaaaaattagccaggcgtggtggtgggcgcctgtagtcccagctactcgagaggctgaggcaggagaatggcgtgaacccgggaggtggaactcgcaatgagccgagatcgggcgaagtgactcgcgcctgtaatcccagcactttgggaggctgaggcgggcagatcacttgaggtcaggagtttgagaccagcctggccaacatggtgaaaccctgtctctactaaaaatacaaaaattagctgggcgtggtggtgtgcgtctgtaatcccagctactcgggacgctgaggcaggagaatcacttgaacccaggaggcggaggttgtggtgagccagggttgcgccactgcactccagcctgggcaacaagagcaagactccctctcaaaaaaaaaaaaaaaaaaaaaaaaaaaaaaaaaaaaaaattagctgggtgtggtggtgcgtgcctgtagtcccagctacttcggaggctgaggcagggcaatcgtttgaacccagggggcggaggttgcagtgagccgggttcgtgccactgcactccagcctgggtgacaaagcgagacccagtctcaaaaaaacaaaaggttccttgctgtcgtaacatgcactgcctttctggatatcttcacactgttttcctagatcatacaaagtataattatctcaaaagaatattagttcaggtgttccttatttaagcattgattacttaatggaaactggtgaatgatcaccgtttttttaatcatcttctttaatttaatcaccttgattgaatctaaaactgattgctatttatagagatatagattctaagctcatctttgaactcacctctagtgttcattttctactgcattgtcacagacataatgtcaatccggcagctctttttttgttgtgtttttggcggatcttcaaatgccttacttacacctgctattaagggaggtatagatggacttgcccagtccagccccacccagcttgttttcacccagttcaaccccacccagcttgttttctctctttggaaccaagcagggagcacagaccactgtgcattctataggacagctcattgcctgaggcaatagagagcatctcacagtaaacaaagatcactgcttacaaggtggcatcaggcaaagagagggcttgt

SEQ ID NO: 483 - DNA, 20470 bp, Homo sapiens
cctatcccagtctattcatgtcatgtattctgtttttgtctcttcccacagagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcagccaagacacagtgcttcacagtcgtgcccttgctgtgcaaaaccatagccttctcctctcaactcacagctgcccaaaaggaaggctttccctgtgccttctcccccaaggaggggagataaagaaccagaattaactcatgaaatacaagagtattccaagaagatttgggtgaaaatacttgtggtttgggggatctctgaagttttttaaacagaactcaaactatgtgtttctcatatttatttttattttttaaagtgtatgttgcctggttataaagcagacttcttgcctatcttgctgctctgaaaggtttgtgactctgactgtgaggccacatctttatatcccttcttatagtaagagaaacaagtctttctgatgaaaataaaaatagtgaataaaaatgcatttactactggcttttaggatgctcaatgatgatgctagcaatggtggtagtggtgacgttggtaatggtggtgatgagtttaggttgcttttgtctagcatttataaatttccaaccactttaaaacaatctcattttagagtggaatagctaagtccattatcagaggttaatgctaattttctgttcacatagggtctgagtttttaatgtaaaaaatatagttagcactataaatagatatctgtcagccgatacagaacattttttaagatcacttccagttgctgcaataggaatatgtattcctattttttttcttttttctttttctttttttgagacgaagtcttgctctgtcgcccaggctggagtgcagtggcaaaatctcagctcactgcaacttctgcctcctgggtttaagcgattctcctgcctcagcctaccaagtagctgggattacaggtgcctgccaccatgcctggctatttgttgtatttttagtagagacgggatttcaccatgttggccaggctggtcttgaactcctgacctcaagtgatctgcctgcctcagcctcccaaagtgctgggtttacaggtgtgagctactgtgcccggcctttttttctttttgagacagggtttcattctgtcaccccggctggagtgccatggcagtgtgatcacggctcactacagcctcgacttcctgggctcaagcagtcctcctgcctcaggctccctagtagatgggactataggtgtgcatgaccacacccagctaatttttgcattttttgtagggacaggtctcactatgttgcccaggctggtcctaaacttcttggctcaagtgatcttcctgccttggcctcccaaaatgctgggattataggcataagacaccatgcctggcctggaatatgtaatttttaatgagacctaatggtataatacattctacctggttcaactgccttcttttaatatctggattccaatattctgctcatgtttcagccatgtttttgcaaacagtcctgaaattcactctaataataagtttcattttcccagtctgattgttatttagcacctcaaattattattgaactcatcctaatcctgattaggcaaatggatagtgagaaaatattacaagtgggcttggattttaattttttcaaacaatttaaaacccattttccttttctaatgatcaagatccaatttttagataatcagtactctctctttctatgtggacatgtaatatgaataggtatattgtttctgtcacaggcatcgcaaactcatatcttgcttgaaacttgtcgatgaactcctttagtatgacaagaacaaagagaaatagatttttaaagcatagccacatattggacatgagtttttcttcaaaatttcagctgcagaaccctaactggtgcctttccttttattgtgttatgtaatctaaggtcataataagtaactaaattattgatttatttttccactctgtaatctctccattatatttaaaaatagcagctatgaagcaaaacaagttcctcgttgggtacattgcctcaactccaaaatctaacaagcagaagtttaattcagtgctttgccatttcatactatagacaccgaatgtcctatcctataaggggcacacagtggttctctttatagttctgttagctcaagtggtatctttaggtacaatttttagaatttttttatttgttaatctttcttaaggtatgattgacagaaaaaaattgtaggtatttaaggtatacaaggcgatgttttgatatacatatacattgcaaaatgattaccacactcaagttaattaacatatccatcacctcacaaagttacctttgtatgtatatgtatggtgagaatgatctactctcagaaaatttcgagtgtacaataatcattaactatagtcaccatgctgtccattaggtctccagaactttcgagcacactccaaaacatcaacttttattctgattaagcctcaaatatgtcttcttgttgcaaatattagctatttttagattagctataaataatgaaaaatgctagcataaaagatggaaagaataaatgcagataagggctctaaggtctttacactttccaggaagtgataaaagctgcaatttaaattatacatgaagaagtcaaggatggcaactcctataaacagctgatacttcaaacctggaatgtctagtgctaagcagcccggacccctgcacccagcacacctctctttggcatgataggaggatgagggatccaggtcttctcctcccatgctgcccttggcctttatgttttgcctttcattagtaaggcttctcccttaattatcaccctatgacaggaaattcatcctaagcctggacacgtgagagatggtaactctgaagcagccccctgcggatgacaccaaatgaggccacacccagaacaaattgcaagaaataacaaggtatttcttacagaatccctaagagaacatgtctgtctgcatttaagtgtctacagtcataaatgcacagcatatgattggatcagatggaactgaaagactttcagtgcttcatggtgcccataactctcattgtcctgaagtggtgttggcagtggactcagcagggtgccgtgagatggtgaggctacacacatacgatcgtgaccaagctggctacacagatgggccaaactcaccctgtgatggtagacagagcttaccaatgggttccatgaatggacaatgggcatgctgctgtaataatcccttcgaccatgatggaagtcaggcaagacccaggccatgggaacattgaaaacagtcacctctagcctcaagtatttcctactgtttgccacactgtgcctacaaatatcatttatgatacagcttaaaattttcatgtttgtgaaaattattatcagccttatccaatctgatattttgaatgaaatcacattaaaaccatatattaatttaagaactggcatcttcataatagtgagtcttctacagtttcctagaccactaaaaaatcatggattgctatctcagacttgaaatgggtgatccttattcttctctcagtcagaacagtgaaaggtacagattcatggcagctagtccagcttctaaaagtcaacttctaattgtctactttaggacaaaaaagaaataatatccttaggaaggccaccatggaattcattctatctgaacaatccttacataatatcatttcttataatatgtcctcaacatcgtgctctgcatatatttctccaccatctctaaaaatcctcttagcccaggcctcctcaaactttaatgtgcatgtaaattatgaccttgttaaaatgcagattctaatccaatcagtcagggttggagctaaggttccctgtattttgaacaagagtccgtccaagtgatgccaaagctgccagtccatggaccacaatgagcagccaagctctagatgacacctacaataattacaggtgtaaggcccctcttctcaagtatcattttgcacagttcctggactaggtcagatacagaccctacttaccacatgtatctctgtattccaagtattacgtaatcatcagttttcctaaatctaggcaccaatattttaacatatattttcatggtataaatagaaattaattttctatagtaaatacactaatacctaatcacattcatgcatctttaatgtgagtagcaaaaagccaaggcactatcttaatggttattgagtgagactttagcaaatactatctttatggagaaacctctgggctgctttttaggatgtgagaaaagtgaggtaaagtgaggagaactggatgaacacgggacagagacagggacaggggcaaatatggggacacctgtctcaaggaagcagcaaatgatatagaaaataaatatctgttccatccctgttccagacaagcccatgtacctgccaagtaggaagctgtgtatcacattgcaacaaggaatgaccccggccctggtaaagtcaacagcaacagtcatcacaggccaatctgcctatcagggactggagactctctaaactcccacctctcaacccaggaatcagagcctgagacagacagatgcttcattcctgtatggggtggtattcctgccatgggtcctgggcttctccactggatggccctttgtctccttggaacaggtgagtactgggcagaaaggaaatctttgagcaaagctatcttgtcctcagtctgcacctttcattcacagcagtaacactgttctccttaactctgactccaaatttgtcttctttctctacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacacagccatgtacctgtgtgccaccagcagagacacagagctgcagtgcttcctgctctctgttcataaacctcattgtttcccagatccaggtgctttctctaggacttctccctcaccacctcttacaacaataggaagtgggttggtggctgtcaatatctgtagacagaagttgagcacaaaccaataaaaaccattgacagttatgccaagagtggaaaagtggttacacatgcctggcattcagttggtggtattttcccaggatcacatttagaacccatgctgtccttttcagaagacaaataagaactttttctttctttttttcattgttttaatctaagtcagaggcttagaaatataagaggtgatatgtgaagaattatggacacccaatgtctatgaagtccagtctctggcattcgatgaactcttataggatttaatcctcctggagaatccacatgtttttagcctagacctggagcaactacctcattaatgggagaatgaaagcacaagtatcccaagataaaaatttctcagaggtaaaaccacattggagagaaaaaaagagaagaccatacattaatctgctcatatctggagttggaggtactattgagatgagcaaatggaaaccataaatacataaagaaatgatattgaaaatagagtacatttggagatgaagatcatggagccatctgtatagaagagagtaataatgtcattaaggtgcataagagtgccagcaaatgtcaataagaaaaactacaggagggaagaagatgggagatcctgctccccttaacaaagataaataaaatgctgagtgagaaatattgcaacctcataaattgtcacatggaagtatgtatttataaattaccattataattaacatccctcaatgagaacgatattctgagaaaaaaaagcagaaaatatagttatatggctatctaaaaatgtaaaattttgcacattaaattaagataatctaggaaaaatatgacaagacctattacaaaagagcttttacaaattgtttgctttaatgatattaataacataatgatagctaacatttactaagcacatattacatgctagaccttaagtcttcttcacatatatttatagttcatgttagttttataacaacctcagaaagttaatactatagtaacctcactcatttatccatgaggaaactgaggcacagacaagtaactagccctttatcacgtatctcgtttgtggtggagccagtatcaaaatgtagacaatttactgctggagctcattctgtcttcggagtttacatggattctaagtcagaccttcagataggaaggtaaatggttataagccagaagatttccacactctcaccaacattgcactggcttttctttgggtcttggccagagggtgagcccttgtgactatgcttcactggttgactaggtttgagttgcaccgaggaccaacatagagaaagaaggtctttgggataaacctgggaggatgaagggtaaaaaatgcagaacttaaatcttgatcccaagggatcatttaaagatgaatgagtctcccttagaggatgagaaattaaacataaactctttaacttgcagagatgctgaagtgttttcctcaagtagtaaactttgaatcatggttatatgcatgggagggagcctatggggatggaacatggatgaaaaagtgacaggatgttcagggggcaggtgcgggcagaaaatcagctgcctccaagagtggtgagagaagctgtagagcatcctttatccagactggcacaacatgcagtccagaaggctgtgagatacgaggaaagggtcaccataaactgcaacctgactatgtcaaaaatgacacttggaatccgagagtgggtacgtgtggtggtatcacagatatacacccaccccatccccgcccaactgggagataagagacttacaggtttagcactttcaccactgggactagaaccctggatttagctagaggctggcttagaccttttcatggttcttctgtatgaaccacacaatttagaaccatactatttagagatgatcaatttatacgacctgcataaagcctgtctttccagaagaagctcaggttcaaaaaaaaaattgattcctctcttgtccttctcaatcttccctccttccttctttcctttcttcctgcctgcctgccttcctcattaaggatagacatgaactagtcacctgtatactctctgaggtatgctgttagtgctgacaacacattagttcaacctagaaaaactaaccctgttttattttatcttatctgagagtctgagacccctctttgatccttaaaaacttgccaatttcttgccaagcaaatatgtgcagggttttagagagccgtaggtaacagagacaaaatagaaacaacacacagaatttggagcaaagcctttagatctctaaagcttgaggccccactgctgctctaagcctgcctatggcaccaggttcctctgctatgagtccctctgcctcctgagggcagtgagtcctgggcgtagatagtctgtctgccttgggcactcacactgtagtctgtttccacaccttcctctggtagtccaatattcacccccattttcctctctagcccctgctcctacactctagtccacagactctgtggatatcctaatcacagagacagaaacagaggtgacactcagatgtgagtgatgaaacttacaatgctgtaaacaagactcaggacttagactgcctactgatgttcattcttgtgccatttgttcagcaaatatgtatttaggaactcctgtataacagaccttgtttccggttctggaaataaggtaataaacaaaccagagagacttgttttaaactcctggaatttataaaccaaagagatgtatgtgatgagaacagtacgactctggataagaaggaacctgttaccttaacactggccagtgcaaacccagtctggcagacatctgtgatcctctagacttgtaaggaatcctatagctgtatagctctttgcatttaagggcaaaactagacaagacagaacctcactctcatgaatccatgccctaagaaagagaagaaacttccctcataggaacattggtgcagtctcgcagttttcttatcaagtaggaaaattagaactgctaaaactttgtgccagaatttaagacaaataaattgcctggatcatgcattatttacaattatatttacaattatatacagatattttccctaatataaatctgttgatgaaccacttatgtggcatataaataggacttattaaaagttagatgcggtgctttagaagatatattaaaattattagagtctgacttaaatttttaatagtaatacaaaatataaagtaccacagccttgttcagaagaaacaggatttctgaaatccaccagaatagctttctaaaagccagtatcttatggcctttagtgggctgaaatacttataatgatggattggaaaaatggatgtttgagtgcataaggttcacgagtataagaaacaattggtacctcctaactatagattgtcagtttcagaggatgagaatgaatgtgccctcatcctcattttaattttgaaagacaatgcagatatccctactatagaatcattttttacatcaccacctatagagattaacaacatagatgtttccagctccctaagaggccaagaagtattaacccaaggtcagattcaggtaattgatcgtgactcacgaattttcagagatccacaatggttgtttttaaattttcagcagttatgtctttttctctggggagagggtattcaaagctcctcatgaggccattctggactacttttcccctcctgccccctgcccataaaacagtttacagaaataggtgtccagaccgtgggctgtagttcaccaactcctgctctagcctaattttgtctcattactagagcatggccattctgtggatgccagtgaagcctttctggggtttctctccaatgccttttaaagctttttcctacacagacacagtttactgtttagccaaaaaattaagataattcctccagacatctggagttcttgtgcagcttcctcctctctggtggtctttccttaaaaattctagctgcctcagcccccgctgattttgtaacctgtttccgcaactcaaaatttgccatgctctgttgctctcttccccattgtgtatgtgcagaaattgcccccatgttttggtgttttggcagaatcccagtcctgtgctgtctgctttccagtggctgaatacaattgtttcacatattctcttaatttgtgttacttgtatagagcaggatgctaaaggcaattggattctacaaagtgatcacgtcacagagaagccgccgacagaggtggagagagccacacagatagccagctgcctgtgctgcctgctcttcccctaattctgccatgagcccaatattcacctgcatcacaatcctttgtctgctggctgcaggtaagtccctgttctgcagttgtcagctccctgctctaagcctttcatccatgtcatcgaactccctcatgggctcagtctccaactcctgtctgctttctttacaggttctcctggtgaagaagtcgcccagactccaaaacatcttgtcagaggggaaggacagaaagcaaaattatattgtgccccaataaaaggacacagttaggttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagccaatccacaatgttaaatattagctaatcttaggacacagactcatcacggactcagctcaggaagcaggtggtatactaggttggaaggaaataacagaaactagagctagcttaagccaaaggggaatgtattataaggctaaatgtatgtcccatagaaccacaaagcaagaacacaggaacttcccagaaataaactgcaatgaaaccttagaaccggtggtcgcgcctgtaatcccagagctttgggaggccgaggcgggaggatcacaaagtcaggagatcaagaccatcctgactaacacggtgaaaccctgtctctactaaaaaaaaaaaaaaaaaaatagccgggcctagtggtgggcgcctgtagtcccagctactcgctactcgggaggctgaggcaggagaatggcgtgaaccgggaggcggagcttgcagtgagccgagatcgtgccactgcactccagcctggacgacagaacgagactccatctcaaaaaaacaaaaaacaaaaaaaaaccttagaaccatggcatggctgattgacaactcattttttatataccttgtcggcctcattattctcttttattataagttgtcttttctgtttcttaggtcttacagtgattagaaaattgcagatttaggtgttagccctccagtcaattgagaccaacgtgactttctctcatgctagattacaaatccagggtgcagggggaaaaaatgtgatcctgctttactcaagaatgggctcgtggaaatccaagggaattgaattattttgaacaagatagtatctgggagtctgtccctctgaccttgtggaccaaggatttcaaggggtggaatccagtcagaacatccaataggcacccatcacaagtgagaagttggggataatacattttctggaatatagagaccttgggaaaagagaagagtttggagaggggatcaaaaccttattatttagaacaatatcagaccacgtaaagagtctggttaatctctctttaagaaattaaaccggccaggtgtggtggctcacggctataatcccagcactttggaaggccaaaagcaagcagatcacctgaggttgggagttcaagatcagcctgaccaacatgaagaaaccccatccctactaaaaatacaaaattagccaggtgtggtggcacatgcctgtaatcccagctacttaggaggctgaggctgaagaattgcttgaacctgggagggggaggttgtggtgagccgagagcgcaccactgcactctagcctgggcaacaagagcgaaactctgtctcaaaacaataaataaataaataaaatagaaggaataaaaagaaattaaacctagataacacaaaaagcatgttcattttaagtgtgacaacttcagatcctacaaattcactaattggcctctatggcactgaaggagaacagattaatgtactcttggtgtaaaacatattaatgcacagagaattaaaagatcttcaggtatatgattcaaattgtaatgaggggcaatgtactcaacatcaatattcctaatgaggcattatggtatcaactgtacctaggcaggagactacacttatgttgagcagttatagaattcaaaataactctgttaaaatttgataatccattctgttcacagatctggtcaccacctagcattcgctttgagagaagttcctttattctctccagttacatctgctcttatttcagtataagttgaacccagttgtcttacttccagaagtccaaagttacttcttttcttgggaaaaaaatttactgtgactcctggaaacagaagttctcactttatcatttttctgatctatttaatattataccttctcattttaagttccttttcccgctctccagaagtgagtgttccttagcgttctgttctcggtccccctcaagcccagtcttgctgttggtggtctacatctttgcttttgtcacagggaagtcactcctctagatgctatcttcagctttttcttgaaatatttccattctaccaaaactgttctcctaaagattaaaattacgtatttcccagaccaaaagacgcatgtgtgtttctttgcctgcttgatctctttgaagctcttgacaatactgaccatgccctaagtcctgagcattaatttttgctcagtttcatttacatcattttcaactagtttctcattttctctctattctttttgttttcaatgcagctcccagaaactaaatctatccatttaatattctttttcccaggaaaattcttctcattctatttaaagtgtaatattctagtttaatgggaaagttttttgttgttgttgtttagccttttaaaaatctctactgaaaaaattttggatatgaaaattagccaggcatggtggcgggagcctgtaatcccagctactcaggaggctgaggcaggagaatcgcttgaaacttggaggcggaggttgcagtgagctgagactgcaccactgtgctccagcctgggcaatggagagagactccatctcaaaaaaaaaaaaaaaaagaaaagaaaagaaaaaattgtgaaatgtggtctgagacaacttttctcagtgtcacctgaggcatgggttaaacaggtatattctaggacaggttcagaatttcagagtcgaaatttcttgttggtggactttaggaatacgtatcattgctcctgagtatttctgttagtgctgaagttctgccccaaggacttcataagattaataacatcgcaaatcttctgtagtgctttaaaattttgttcttcatttttttattctcactttcttctctttccttttccacttcctcttatgttttccttaatcttcaactttcctaagcacctgcaagtgggattggagccttgtttaacatcgtccatgtagcaaaataaggatgaggccaaatatttgaaccaaggatccccatctcctatggaaggtgccctgaggttgtgggtgttgctggggacatgatgtcatggccagatcctacatcatgcggccaagggaacccagaactttcactgctctttgctactgcacatcagaacccatcgctgggagtgtcttgcactgcctgacctcaccatggatatctggctcctctgctgggtgaccctgtgtctcttggcggcaggtgggtccaggtatacttaaacatttgcataaagatgtttttggctgggcgtggtggctcacagccgtaatcccacctttttgggaggttgaggtgagtagatcaccagaggtcaagagttcgagaccagcctggtcaacgtggtgaaaccccttctctaccaaaaaatacaaaaattagccaggcgtggtagtgtgctcctgtagtcccagctacttgggaggctgaggtgggaggatcacttgaatctgggaggtagaggctgcagtgagcagagatcacgacatttcactccagcctgggcaacacagagagaccctatctcaaaaaaaaaaaagatgttttctttgggcttcccttcaccttctatggcttccgtcttcttccacaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagcggtggcacagcatggctgagtcagttccctccagggtgcaaaccctctggctgctcttctcccagttgaactccaagaaaacatttgaaaaagcctcttccttatcttcctaccccagaagaaagaagcgagttgattgttgtggctgcagctgctaccgggagagtacaagaccatgaattaaggtcttaaatggtcatgatgggcacactggacaatgggctcctgaaactacccaaatacaaaatgagacattctgtggatcaggaggaatccacatgtttagaaggaagggccccagaccaatttccaagttcagagaccagctatctgaggttgatattacttaccaaaacacaaaaacattcctactgattttatctcaaacacagttctcctgcaaactcttcccccaccaacgtaccccagcagaggcaatgacatgtacatttatggaacagcctgttgactactgcagatccatctcttcaataagaccaactttccctggaggtcagtgactaaaccaaaccgcaaggcagacggcaacacgaccctcttaggggatggatgccagagaaacactgactaaaatccccactcggggactgtcctagcacattcagttcctcacacagctgcacaggggagcgcgacgttttattctgttacttcaaacactcatctgttcctctctctctcttgcaggccctagactcacagacactggaattagagtcagaaaaattgctttctaatcccaaaactggttttgtttactccccttcagctgtgaaatcttggcaaatgctcttacttctctgggactcagtgtcctcctcttcaaaattagagacttgctccacttagtctctaagatctgatacaaatatgattatttgacttgctatttatttatttatacaaatattagaatatttatgtatacatttaacataaatatatttatatttaataaaaacataaaatttataacattttatataaatttatatcaataatatatatttattgatatacttatatcacataagagatatataaatatatgcaaatatattttatgtaaattttaatacaaatataaaaaatacattttctatataagtatatataaatacttatatataaatgtattttatacatttatatataaatatatatataaatatatatttatatataaatacaaatacttatatatatttatatataagtattaatatataaatatatgtgtttatatattattatatataaataatatataaatatatgtgtttatatattattatatataaataatatataaatatatgtatttataatatttatctatttatctatctacagctattttacacatgtgacaatcagggttgcgatggaagacatcactacaagctggaaaatatgaacataattacatatgcagataacacagatccagagactatctgattgcaaggaacattatagatcacccctatataccataactttgaagctaatttgaaatgtggtttgtgaaagtattatacatttcctgcaatcccctccactgctgctagatggcagtaaaggaacgtgttagaaagtctggggaggggacctcatgatttatttaccgcgcagtcatgatttaccacgcaatcacggtttagtcttgttgtcctgtcataattaatagtatcctctttcacatacaaaagtgtctcaatttgaacattaaactatacggtcattgtagataatgacacaaatgatagcatctctgttgaaagtaaattgtttattaatgttgcagtaccttcatttctttgtttcggtttaatgaaatagattttttaaattatagaataaataaactcgaagctatagcattggtctgctttttgtcattttactatttaaatatatctcagccctacttacagtttgtattagcgatatgtggtgtatgaagcctcaacttaaaaactcagcttggtcttcgtagtgcttctgtcactgtctgcccagcacccactgcctctcaatgtgttccaacgtttcccaattcctacctgctaataaacctaccaggatatttccagacctattttctctgtgaagaaaaccaagcgacattgactttccctcattcatctactaatacataaatgtcaccacatgccagtgacaacggggtaaaataagtaataaaagtgaaataggataaaagaattgttatacatttattggctccggagaaatccaccctcttctctctagtctcctgcgcaccctgccaacaatgtcattggctgtaaaaatacctcatgttcatttaacactctacagtttactgagtaatttgttgtttcattttcatgctttaattatatgtttccaggttctctgagcttttgagctcctgctcttcccagatgggctttcataacaaggccagcccctttctctctccccttccgccagtgcccatcatttgaaccaaattttcttcctgtctctcttacttgattctttcccaacctgtgccttctgtttggtctcttaaaatatttccctattcagtgataactcccttaatgaaggcatctttattgactgccttggaaatcctcagaattatagaaacatctttcatgtccaccttggcatgttttatatgtttcacatatattttcataaataataaaaaagttatatattttccatacgtaataaaaatgtcccttcaacatgcgtaatatataacaagattagtgatcttccacctaatgtcttggacaatgtgacttctgtctgataggtatagtctttgacccctacttactcatgattaaagaaatacctttctctcaaaggaactatctgtgttcacagcgttaagtctcatcctggatgctgcaagaagacgttcaaatgtccactgcccacccaggtatgtgatgctgcctgccatgggtcactagaaggtgatagttaaaagtgtaggctctggaatcaaacaatgcagaccacaattctggctcctctgctcaaatgctatgtgaacgtgagcaagactgtgaacctctctatgcctcacttcctcacctctaaaatgaagataatagtacctacctgaggctgagcacagtggctcatgcctgtaaatcccagcattttgggaggccgaggtgggtggatcattccaggttgggagttcgagaccagcctgaccaacatggagaaaccctgtctcgactaaaaatacaaaattagctgggcgtggtggcacatacctgtaatcccagctactcaggaggctaagacaggagaatctcttgaactcgggaagcggaggttgtggtgagccaagattgcaccattacactccatcctggatgacaagagtgaaactctgtctcaataataataataataataataataataataataatacctacctgatagtattgggttaaataagataattcatgaaaatccctagtgtggtgcctaaaactcaaacgctaatatacataggtttggcctaatattatgaggtgttattatttaggattgctgtgcttcagctttttgttgagtttcacggtttggctcttactggaccactgacagaagcaactccatgactggttattctgtcattacccccagatactgtgcgataccttccaaatctactacaaacaacgagtgtgcatttctcttgcttgttccatccaagaggaaagagatctgtccagagatgtcattctgcttcagtcaacccagccgtgccagacaatatcagcataaatgtcaaaattaccatatgtggtcaacatatgctgatactgtgaccatatgctacatgggacttgttcccttaattgtgaataagagaactattcgtgtaggtgttattatccccaattttataggctcagaaagagtaataattggtccaatgtctcacaactgtatgtttcatggcaaagattggaaatgaagcaataacttttttctagtaaaattacaagaatgaccttaatttctttctaagcaaacgtagcgtatcatcacaacagttatgttaaatcagctcaataatctcctagaagaacatattataatattcattagaggtggtatgggctttaagagggagaaaaaactaggcaggatattgctatatgtgaagtaccatgctagatatttcacatatggtatttcatttcatccataccagcaacccaaaattatgttatttatccctgttttactaacaaagaaattgaagtttaaggagggtaagtgcaggatgaacactaagccaattgtagagctggcttttgtaatcagggattttatttaattcgatttgctctactatcatcatgttgaattaagaatggcaaagggctgggtgcactggctgacacctatagttctagctactcgggaaactgaggcaggagggttgcttgatcccaggagttcgaggctgcagtgagatatggtcatgccaccgaactccagcctgggtaacagaatgagaccctgtctctaaaaatttaaaaaaaaaataagaaattttcaaaaaagaataaaaattaaaatatatatatattttaaggctgggtgcggtggctcacgcctgtaatcccagcactttgggaggctgaggcgggcggatcacgaggcgggaaatcaagaccatcctggctaacatggtgaaaccccatctctactgaaaaatacaaaaaattagtcgggcgtagcggcgggcgccggtagtcccagctactcgggaggctgaggcaggagaatggcattaacccaggaggcggagcttgcagtgagctgaggatcatgctactgcactccagcctgggcgacagagtgagactccctctcaaaaacaacaacaacaacaacaacaacaaaaatttaaaaaaatgtgtgtgtgtgtgtgtgtgtgtgtgtatacatatatatactttttttttttttttaaagaatgagaaaggaactagaacaagcagagagaaaaagcccaggggcacgacagctaaaggatgactaatggaagttgaaaataggaagctgaaaggtacagaaatactgcgggaagacaaactacaaattatgtggagaaagacaagaataagaacagttcccagaggtctgaacacagcacattatgtcttcttgctatacagtggccaccaaacttgtcaatactgtaggcaaatgctagtgtcattgcttgtggctaagcagaaattttgacacttgggaaggttggcatgagattgaacagttgccatggtgacctgccatagatattttgattgatgatgagtagacacaaagtgccaatgcttaagacctagcttcagatacttaggatttagtggagaggctgttttgactatttcttttcttttcttttcttttgagacagagtgtcgctctgtctcccaggctggatggagtgcagtggcacgatctcggctcactgcaagctctgcctcccgggtttacgccattctcctgcctcagcctcccgagtagctgggactacaggcgcccactaccatgcccggctaattttatgtacttttagtagagaccgggtttcaccgtggtaaccaggatggtctccatctcctgacctcgtgatccgcccacctcggcctcccaaagtgctgggattacaggcgtgagccaccacgcccggcctgactatttctgacatctgacttaggctgcacaggaggtggggtttcttgacagggaggagctaatgtagggactgtgatgtgccaggctatttgggttggggtggagaaaccacagagagacagacataagctctctcccttatttataggacatacctactggtcctgccctaggccccagattctttgttagtggccttttctactgggagcaggtggggcattccagtttcaggtgttctgggacctggcttgaagtttttcactgatggctgcatcattaggctcgctcttttgccctttcctcagttcctgtctttttttcactttcagtcacctagaaacgacaatatccaatc

SEQ ID NO: 484 - DNA, 94882 bp, Homo sapiens
taaagtgaaacattcttagagaaattagcaatccctagtattatgatctccagttaaaactctttaaaatttcaagtattcaataacacagctaccacaaatagtaaatgaatttctattatgttcaaagcatgcgacatctggtttagaataaattcctaatcaaaatagacataagactgcatcaatccataggaacaacaattactgttttggtaccaggatagtaatgagtgtttcttaaagaataacatatttaattgtgtagtagttcagtgaaaaaaaattatgtatataaatatccaaatatttatagattaatccaaattcttattttttttttttttactggcagacttggtatttcatgactttaaaactaaaagcacagtttctgaagattaaatgaatttttctctattcatgttatttgaaaagagtataaggcaagtctttttactctattggtatggaacattgagactgaaatttgagaatattgttttaaaatattgaagtttttcccattgccaatccggcattacctccacaaatcataacttattaccatatgtgtacaggatgaaatattaagtgttatagtagttaaattgaaagcctaatactttgtaatgattccatagcagagagctgctacatcatacatttagttttataattatagtggtatgttttacaaagatccgagagtctattacctgtcataagctgagaagtatggtagttcctcccactgctatcttctctaatacatgccttcttccttattggagcaagcaataaactgagtaagatttagaaaatctagttttcaaacttctaaagtttattagttctttgatctaggaaattcactcagttttttgtaattggttccttctatgctgagaagaatatggttagattaggtgggtattttaattattaaatcatgctcatagctagacacacttattatttaatatttcttttcaagatcacttccattttatataaatttatattaaagaatgctgttaactatgacaatatatttaaagaaataagaaaaagttatcaaatgttataggactagtataactttttcataattttgaggataatacctgatgtctttgtgttaaaaaaggagactaaaaagtattaaagagatattgacagaaaatgatcaattttgactttcccttcataatgttatcaaagataccgagctaaattgaaacaggaattatactcttagtgtagtatacaatgtattctaaagctatatctgttaaccatcaaataatcttaaatatcactagtaatacagctacacaatttagaaaatgctgaacttattacatcatacatcttattgcactgaacagttttgcattattaataatttagtatctgtggagtccagatatggttgccatatctgatctaggagtaaggtaaaaagtccacatggatgctgtgtaattcctcaagaatgaagagaatagaatttggaaatgcatgctgtctgtagtacattcttccattgcctttgtgtatgtccagccctgatcatatacaaaataacatgcaaagctgaaaaataaatcatgcaacatataacaactgagtacgtcctgacgacagtttatcttacagttacattgtgtgataactctatcttttattgacttttggtgcctataatttattctagtacagccagaacacacattgtgaagaatgcaaatgacctatgcatttatgttttctttctttctttgcagcattaatattaatgactcttgagtttatcttaaaacattatcttttacagtaaagtttaaataataggtataaacaatatttccatttaaaaatgtaagtaactgacagaaaaactccaactttttgctgtattttcaactatattttgccttataacatagctagcaaagttattttctcaagttcaatatgcagtgcccaactcccaaggcccctgcacttgcatttcaaagaacattgcccactaatcatgcagctcagtttaggcaaattttttagatgtaaatgcattccttgatcatgtgtctgcacacggttcagggaagtgttacattctatgctgggagaagggaaaattacctaaaatgaaaaccctgttatgaataaggaacagaattaaaaattataaatgaaatttccatgtgcatttaattaatttttgttgattctaaatgttacaaataagaatagtgatatatattgttctgaagaactagtatttttttaaatcattatattttcaaacaataaagtatattcttacgttactaatgtgacacagtatttggaaaaatgtttcaaaaactattagagaaatcagttatgatttctaagaacaaatatagttaatatattgattctgaattaacttcagtgatttgtgtaactagattccacgatctgttgatagttttacatgattgtgattacattgtaaatgttttaatccaaattcatttttccctagatactttatttttgcatagcacacaacatatggaaagtcaaaggaacatataaaaattcatactcatgagcctttcctctatccagaacatacaaatatttgtttttgtgttcttattttgtaatgttgccatcttggtgggaaactttctgatccttatctctatttgatgtagtcctctttttaaccaaccaatgcactatttcttcaggctatatgaatatctactatacctcctgtgtcacacccaaaataattggtgatctagtagtgggaagaataaacatctcctatgataggagtctttcccatgcacttctttggaatcattgaaatcttcatccttacagtcatggcttttgatcactatgttgccatctgcaaacctccccgctacctaattatcatgaataggacaaaatacaatactctaatctcggttgcttggctgttggggctttccattctttgtttcagttttctatgaaaatctggttgcctttctgtggctccaacaaaattgatgactaatattaagatatttttcctttactgaaagtcgcttgtactgatacctgcatcactggtgtcctcgtggttgccaattctggaatgtttgccttggtaaccttgttctgtcgtttggctcttatgtcattatactattccccttaaaaaatcattcagtagagggaagatgcaaagccctctctacctgtggatctcatatcaccatggtaatctttttcttcgaaccttcaatctttgcctaccttagaccttctcacttttcctgaggacaaaatatctgctctgttttacactattattgctccaatgttcaaccacctaatctataacctgagaaatacagagatgaaaaaggccatgagaaaagtttggtaccaaatatcattttcagaagaaaaacagctgatttgtcctacttagtgtactaaagaactttatgcagcaggaaaagtgtacatgtctccaacgactgctgttaggttataaattttttccttttctagtttaaaattttactgtggtaaaatatgtataacataaatttaccattttaatcatttaagtgtacagttcagtggctttacattcattttgtggttcaaccatcatcaccatccagctccagaactttttcttctttccaaactaaacctctctgctctttaacactaactctccaatgccccttcccccagtttctggcaatgactaatctcctttttgtctctatacattttttattaatacataatagtggtacatatttatgacctacacgtgatatgttgatacatgcatacaatgtgtaatgatcaaagcagggtatttatgatttccgtcacctcaaacatttattatttctttgtgttgggagcattttaattcttctcctccagctattttgaaatatataataattaaattattgttacctgcagtcatcctactgtgacaccaaacactagaatgcatttatctgaatctttttcagtctttacgtaccaatatatatcaccatttccatttataaattccagttttgtgacttaccgggaaagattcggttgtgtccaaaattatatctaaaactctcttggacagtctcatccactcctaattttctacaagttgtttcatcacgaatgaatgatgtctttaatcaaattatttttctggatctattgagatggcaacatttagtttccttcttccctttaatctgttaaggtggtgaattatattgatttattttccagtgttaactcagctttagcttttctaggacaaacacaacacgaaacatacattgataccgaaactagacaaggacaatttaagaagaacaaatttcaaaccaatttgtctcatagacatagaagaaaatatcctaagacacattcttggataaaaaacaaggaatatataaaatgattctataccatgactgagtcaggttttaaatctttgaatccaattcattcacttataattgccagaaatggactgaagtgtatcagcaaaatcacaatttcacaagtgtatctgaaatttggaagagtatatatattttgaaattattctgggctagaggaatgctgtctatgtcatatagagtaagcaattctgaggctgatggtgtatttcaaaaataatctgcatctgaaatttgcacatggaaactcgaaaacctttctagcattctgtaagaatgaagtagactgaaagtggttttcagatattaaaaaaaatagtatttttattattgagctttacttccggagaagatagtcaactaaatcttacatgatgggcactctaatataaactatgtaatgaaaaagtacacagggaattttgcttaaaacgtggaaaataaaagatggtcaaatctgtcctctgtgagctgcaaaagccacttctccattatccttttaaagcatcactggggccaggcgcagtggctcatgcctgtaatcccagctactcgggaggctgaggcgggagaatcgcttgaacctgggaggcagtggttgcagtgagccgagatcgtgccactgcactccagcctcggtgacacagcgagactctgtctcaaaaaaaaaaaaaaaaaaaaaaaaaaaacagtaatacacacaaaagagaaggaaagggagagaaaattataaagaagtcaatttatagcaaatttatattgaaggagtatatacatcataattgggacaagtcaccaataaagaaatgaatatcgtgttaggttttaccacttctctaataccaagtgttagaaaacattgtagtaatgtctacagttttctagagaaaaagggttgagaatgataaactttatttctagtcttactgtctttaataagtgtaggaaataaaatgacatcttcacatttgtttggcttcataatatacactacctacatgtcgttttgaataaaaattctaaaaagtatttttactgataaacattcaccatctttgttcatatcatgcttgatgagtttaagtcattcctcatttttgtgtcatagcctacttatgtttacactgatccctcaaattctactataaatgttgaaacttttctaatgcaaccagcctctaagaaacctttaattcccactttgatggtgttagcaagtaaaaggaattacttattttatagttatatttcaaatttggccaatatactattggcacaggaatttcattaaaattttgcatttcatcactcagacagtaattccttaagcaatatattttctaccaagaacttaatgcacaaggaaatatttttttactattatttaaaaattgaggaataaaaaattcattatatgaaagtataaaatacatgcaataaacaaatttgcaaaaattcaaagatcaaatattatattaaaacattctaaaatattggatgtaattattattagaaagagaaaaagataaattttttatttgtatttttcaagagtagtactactctgataactagaaaagtagcttaaaaatgcatgtacagcatgaaccaattttgttttatcaatgtgcacacatataccttaataatgtttgcctcaaactagagggagaatatattttatacgcattttttaattcccttttttttaaaaaaaagccaacatagaaggataaatgtagattttttttcactggagaaaggagaattcatttgagcaaatgaatgagaaagtaagtctgcaaagttaccaatgcaaggaccccaaatcagagcttgaagagtatctgtagggccagagaaggggacgatcagaggggatctcatggaaagacctctgtgtgtttagaagagaaataattgtgggaatgctacatagactggaggagacatccagaataaaagtgtagtaatgtttgaaaaaagatgaccttaggagtgttggaaatagactagacaaaaatagaatacctagaatgactttcaaattaattctttggagtcaaatcaagccccataacctgccctaggcagctttaatgccttggatatggctttagaattgtctgacatgtttttcacttctacaaattattaaatatctcacataaagacttcagaagaaaaaagaagagacagagagaattacagtggaagtatccctgtaactgtcacatgaatcaagaagcagactactctcatgatctccaaagccactcgacatcctttctggcctcactccttcccttctccttacactcttagagcccatctcatcaggtcactgggaagattaaaccagagtgcttaggatatggtgcctaataaatactcaacatgcatttgccatggtttattctgctcacatagcacttggaagtcagctctaacattatatatagagttaaaagaggaaagaaaagaaagaaagaaatatgaaaatgatgtaagggcttgggaaaaaattaaaacatgttcttttaaaaaattaaaatatgttctatatttttccaaattcttttaatggaagttttacatatccacacaaaagaatactaaagtttgtttgtttatatttttctgaaattctacctagcacttgtaaacaaactaaaacctattatagttctctcagagaacacaatatatacattttttgagggaagatgaagaccattatctaccataaaagcctgagatgtccatctcccttcagtcaatttatggatattatggaaataataagtccttccgttaaaaaagttcttttttttttcatcagaaaactccctatataaagtgcaagagagttcagtcattggagcccccgagactatatgattgagattcctaaatcacatgcaaagataattgcagcttgcatactatttataatccagattctatcctagctgcagcaagcctgccaacttgaatctaaaggaaatggacttggtgagcttaccatttcagaaagtaaattcaaacaacttgcaaggaataaccaatgctctagaatgaaaggaacacagttttaaaatttatactttaagtatttagttaatcatatgagtctggacatctctagaaataattttagtgatgcatatatagattgtgttttgccttatttggatattcaaattattccacttaccttcaaactgttgctctgagcatacgaattcccattgtaacagctgtcagttatctctaaaatgatacactgttgtttccatgaattgctaatagactgagctaagtaaaatatggcattcaagaagctgaaatgaaataatctaaataacaggagaatgaacagaatttcaatgaggacagagagaaaacactggaaaggaaggaacaggaatggattcacaacaattgaagcagaacaattgaatcagagctactgatggttagtgtacaatcaaaacaattacaacatatgtggtaaattatttttcccttcctattatcctgcctaactgtgtggtctttgttgcatatatttttgtctcctttttatagaacacagactgactgtcagttaaatttaaatatagccatcctctcagaatttgatagatcattttttttttagcttagggcagcaatacattcaaatagttgcccaatgaggatgtaacatgatgtcctaaagggatagatagatagtgatagagaatgatgcttaactgggtagcaaatttcaaacaaaaaaaatacagtagtagaatttctggtagaatgtcaacaaagtattgatcaagaaaaagcgtgattcataggttacaaagagaacatatggacataaagatgggaacagtaaacactgggaagtactagagggggcaaggattgaaaaactacctattgagtactatgctcacgacctgggtgacaggatcattcatacctgaaagctctgcatcacaaagcgaacacacataacaaacctgcgcatgtaccattgaatctaaaataaaagtttttttaataaaaagaaatgagaagaccataactgaaaggacatgtaagatcactgcaataaccactaccataatcattattcctcattcttctaaagaaaaaaaaaaaagtccacccaagaattaaccagtcagataccctaggaaggtcactaaacaatcaaatggaaataactcaaaattgggtctgtgtgtacgttatcctatttactttgttccctgcccttgttgcctgtaattaatgtatggtaatgattttaattattgaataatttatttttataatattttaagtcattgaagttatttattttaataattcgacaagtatttgctgattgttgtgtaaatgaatggtagcctgtatttcataagagacaaacaaaaataaaagtcttggaaataattatttatggagtggcaaagatggacttattgacactttcatgcactttatctagttaattacctcaataaaactggaaataaattactcatcagcagtatactcattagtaatacaacaatctgagaaaaaagtattacataccccaaattacacagatcacggaggggtgagtagaattcaaatttaaatttgtacaagcacttcttaatatttcaagacagagcataaaacagtctctgtccttgagggatttaggatcatgaaaatcaaggatgcatagagtttactttggcatacattaaaaattgaaatgtttgcatcattgagaacctctattttaaacaataacagtatgaaatatttattaattacatgttatatattaagtctatattttatagacttagagagtttggtttaatttattatctcattttgtcatccgcatatcaaaattataagggcttttagctcaaggccaatagctctggaggttatctgatttgcacaaaagaataaaataattatgaaatgagtagagaattttatattaaatctgttctactgttttggttctacatcttttatgtatgagctcaggctctggattcaacaaaatctgatttcaagttctgatttgctgcatactagtttgataatctgtatatactttttcaggaaaaccttaattaatttttacatttctaaaatattattactcttggatgtccatcaaactgagcgtaatagcatagtcatctgcatagtgtttttttcttttcaaagttcaacatatatctttaaatttaaaactttgaactatctgatttatatgaggataaattatgtctcaaattttacagtgtggaaggaaatgaaatgaagagtacacatttagaattgatggctgcgtcaagaatagaaacgtgatgtcaactaaaactctaaaattaagaagctagaaatatagatggtagtagatatacagttaaccagatgtgcatgaggaagttgaagataaagggaggattgataacatgggaaataaagccttagctttggccttaagaatggagcaactggagagtcaaacaggtatttagaaatattgttagttcaaaggtcagacaatatctagttagtagaaaactttatttcatgtacataaatgaagatagaataattgtttgactttgccctgatactctaacaatcttaatttcttgagagacgttagttcatgtatgaaccacaatttttatttaggtttttgggaaaaacaagtcaggtgggttttttcgtctccatgcccatgattaaaataatggatttgtttatgtctattgatatgaaccaataaataatgaattgtcaaagccagtcacttaaatattattttaaaatgaaaatatcctctttataggtaaagaaattttcccacctgtaagtatattacatgccgacagtataattggaggcatataagaacaattacttttcaatggctaattctaaatcttggaattgcaccttaaataaattgagttgtttgaaggcctcatttttgttatatttttaaaattaatttggagaatggcacagttaacaacctctaaaagaagaggtgagcaggaaatttaacagttaatggacaaaaaagacagctacaagattatggcagaggatacagctcaaattttaagcaaaaatgataatactaatgatatttagggtcaaatttatagtaaagacaattagactatttggttaaaaattctgttattttaccaacagttttgagacttaaactaaattaccaggagctctggtcaaccccaactacattgcctagattttcatagaacaaatcctgttgatttaatatttgcagattcatgaggatgttcaaacttttttcactctatatttgactttagttaaaatttcttccatttagaactaggggatttgactaagggacctcaaagttttcttattgcttaaataattttataatcctaagatgttattttcttcatgggaataaaattaactggactgtactcttgatgactgttagagtattgatttggtaactctagcgtttaaataaaaaattcagatgttaatagtctctggttaataaagatttattttggcttcacaaccattttgtgataatgtccaggccaatttcctcatttataaatgagataactttaactcagagaaatgaagtgatttgtatccatattcacacactgtaatataattaggtaacagaatccaggttctactgaaaatgtgtctgcacataaaccttttctcataaacttccaaaaaactttgtagctggatttattcaatgtgaggacttttcatggattttgacaagaagcattagttggacaaaatagggaatagaaatacagattccaattcaagaaacagaaaaaattgacttacaaaatatacaaagtcaagagcaaaaccatccaggtaaagctgccttctgctcctctatgttagttttaactgctgctttattctgtggtttatttaagtctatgattctaactgaagtgcctacagaaataaacctatttctgttataaaggatcagcattttactgtcaaaataaaaaataaggaaagggaaagcaagcaatccaagtttactataaccaattgcatgagcttcttgctgagagttttttatttttcaccttgtgaatatatatatatatatatatatatatatatatatatatgtaattacgttaatccttaatttggttttctacatcactctaaaatgatttgaggtataacatattttccaccacatatttcacagttaaactttacatttgtaagaaaataaatattcatgacatactttcatctgtaaccaaatttgagtttataaggattcatgaccacattctttgtgagaagttaattgcatattgggaaatgtttggcaatgaataatgattctttaaccgtgtttaaaatggattgaatacatttatttaaacattttttaaattgactgattgaatgcattcattttatcaatgttataatgtcccaaaaatgacttctagaaatcatcatggtactaattagaaaaagaaaatatttttattaaatatcagttttcattgtctgaaattctgtaatcatatcccttaaacatagttgcataatattagtattatcatcaatactctccatgacatttctgacactgacttatgcttaatgtcctttcaggtggcttttatgcattctttctgcactggttcatggaaaataggaatattgtcactgtctttattctcctgggactttctcaaaacaagaacattgaagttttttggtttgtattatttgtattttgctacattgctatttggatggaaaacttcatcataatgatttctatcatgtacatttagctaattgaccaacccatgtatttcttccttaattacctcgcactctcagatctttgctacatatccactgtggcccccaagctaatgattgacctactaacagaaaggaagatcgtttcctataataactgcatgatacagctatttatcactcacttccttggagacattgagatcttcatactcaaagcaatggcctatgaccactacatagccatctgcaagcacctgcactacaccatcatcacgaccaagcaaagctgtaacaccatcatcatagcttgttgtactgggggatttatacactctgccagtcagtttcttcttaccatcttcttaccgttctgtggtcttaatgagatagatcagtacttctgctatgtgtatcctctgctgaagttggctcgcattgatatatacagaattggtttcttggtaattgttaattcaggcctgatttctttgttggcttttgtgattttgatggtgtcttattatttgatattatccaccatcagggtttactctgctgagagtcataccaaagctctttcaacctgtagctctcacataatagttgtggtcctattctttgtgcctgccctcttcatttacatcagaccagccataacttttccagaagataaagtgtttgttctcttctgtgccatcattgctcccatgttcagtcttcttatctacatgctgagaaaggtggagatgaagaacgctgtaaggaaaatgtggtgtcatcaattgcttctggcaaggaagtaacttgtatgaaaggcattttagaatttcattttaatgcctaaatatcagccttagaattaatatggagtaatacaaaagcatatatggtgcatgcaagagccagctacagataaaagctcagtatctccagcacttgctcagacctcttctgcttgggcaatttttattattttattttaatgcttattcttcctttattcttctcacgtacctgcctcaagttctccttgatttgacattttatttagaatgtttaatgaagtctagtctcccatccttttgatttttaattttattctaaggggaaattgaataaatttattctattttattatattagacagaaactaatggaaacccatgcagtaaaggagaaatatactcctactcccagcatctcagatgaaagtatataaatgtagatttttcagctcaagataataggtaaatgagtggaacatttaagtcctttagctactcaacatttataaacacacttctctacagtaagtcctcacttaacatcgttgataagttcttggaaactgccagtctaaatgaaatgtcatataatgagacatattatatggcatttcatataatatgaaattacaacttcatattctctcaaatattctatgacatatttctggccttaacacccactaaatttctaaataaagaccaaaacacttctaatattaaatattgaaataaatgtgagctgtacatacatttaggaaaggttaataagcacaagtaagatcattatttgcccagtgatggagattcagattcataggtagctgaagcctttccagacaggtcagggtgcaaggtgggaaccactctgggtaagactccgtcccgtcacaggacacacgcacatgcagacccacactcactcctcctgggaccttgtagacatgccagttcaccaaagcagcattgcttgggatgtgggaggaagccagagaaaatccacgcacacatggggagaccatacaaactccacacagacagtggccctggcctggaattgagtttttttttttttttctcattaaccttataacaagatgacatttaatgaaacaatgctattcgaggaccagctgtatattttggaaactcctttagaaaataacacctctatgctgccattgagtaaggtgcttctgcaaaggtacctccttctacccccaaaacataatatcccaaccattctggataatgttatatttcaatgtcagtttatcttccagtccacattattataattcctttgaaatgatctgtaatccaaaggatacattgtaaaatcaatgacctaaaacacttaatataaaataataagaaaaaagagagggaggaggagccaagatggccgaataggaacagctccagtctacagctcccagcgtgagtgacgcagaagacgggtgatttctgcatttccatctgaggtaccgggttcatctcactagggagtgccagacagtgggcgcaggccagtgggtgcatgcaccgtgcgcgagccgaagcagggtgaggcattacctcacctgggaagctcaaggggtcagggagttccctttccaagtcaaagaaaggggtgacggacgcacctggaaaatcgggtcactcccacgcgaatattgcgcttttcagaccggcttaaaaaacggcgcaccacgagactatatcccacacctggatcagagggtcctacccccatggaatctcactgactgctagcacagcagtctgagatcaaactgcaaggcggcagcgaggctgggggaggggcgcccgccatcacccaggcttgcttaggtaaacaaagcagccaggaagctccaactcggtggagctcaccacagctcaaggaggcctgcctgcctctgtaggctccacctctgggggcagggcacagacaaacaaaaagacagcagtaaactctgcagacttaaatgtccctgtctgacagctttgaagagagcagtggttctcccagcatgcagctggagatctgagaacaggcagactgcctcctcaagtgggtccctgacccctgacccctgagcagcctaactgggaggcaccccccagcaggggcacactgacacctcacactgcagggtatgccaacagacctgcagctgagggtcctgtctgttagaaggaaaactaacaaacagaaaggacatccacaccaaaaacccatctctacatcaccatcatcaaagaccaaaagtagataaaaccacaaagatggggaaaaaacagaacagaaaaactggaaactctaaaaagcagagcgcctctccacctccaaaggaacgcagttcctcaccagcaacagaaaaaaggtggatggagaatgattttgacgagctgagagaagaaggcttcagacgatcaaattactctgagctacgggaggacattcaaaccaaaggcaaagaagttgaaaactttgaaaaaaatttagaagaatgtataactagaataacaaatacagagaagtgcttaaaggagctgatggagctgaaaaccaaggctcgagaactatgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatcaacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggacaaaatgttaagggcagccagagagaaaggtcgggttaccctcaaagggaagcccatcagactaacagcagatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctcagagattttgtcaccaccaggcctgccctaaaagagctcctgaaggaagtgctaaacatggaaaggaacaaccagtaccagccgctgcaaaatcatgccaatatgtaaagaccatcgagactaggaagaaactacatcaactaacgagcaaaatcaccagctaacatcataatgacaggatcaaattcacacataacaatattaactttaaatgtaaatggactaaattctccaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcagggcttgcaatcctagtctctgataaaacagactttaaaccaacaaagatcaaaagagaaaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaaaaaggatacccaggaattgaactcagctctgcaccaagtggacctaatagacatccacagaactccccaccccaaatcaacagaatatacattcttctcagcaccacaccacacttattccaaaattgaccacatagttggaagtaaagctctcctcaacaaatgtaaaaaaagagaaataataacaaactgtctctcagaccacagtgcaatcaaactagaactcaggattaacaatctcactcaaagccactcaactacatggaaactgaataacctgctcctgaatgactactgggtacataacgaaatgaaggcagaaataaagatgttctttgaaaccaacgagaacaaagacacaacatagcagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatcctggagctggttttttgaaaggattgacaaaattgatagaccgctagcaagactaataaagaaaaaaagagagaagaatcaaatagacacaataaaaaatgataaaggggatatcaccaccaatcccacagaaatacaaactaccatcagagaatactacaaacatctctatgcaaataaactagaaaatctagaagaaatggataaattcctcgacacatacactctcccaagactaaaccaggaagaagttgaatctctgaatagaccaataacaagagcagaaattgtggcaataatcaatagtttaccaaccaaaaagagtccaggaccaggtggattcacagccgaattctaccagaggtacaaggaggaactggtaccattccttctgaacctattccaatcaatagaaaaagagggaatcctccctaactcattttatgaggccagcatcattctgataccaaagcctggcagagacacaaccaaaaaagagaattttagaccaatagccttgatgaacattgatgcaaaaatcctcaataaaatactggcaaactgaatccagcagcacatcaaaaagcttatccaccatgatcaagtgggcttcatccctgggatgcaaggctggttcaatatacacaaatcaataaatgtaatccagcatataaacagagccaaagagaaaaatcacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcacaactcctattgaacatagtgttggaagttctggccagggcaatcaggcaggagaaggaaataaagtgtattcaattaggaaaagaggaagtcaaattgtccttgtttgcagatgacatgattgtatatccagaaaacaccatcatctcagcccaaaatctccttcagctgataggcaacttgagcaaagtgtcaggatacaaaatcaatgtgtaaaaatcacaaacattcttatacaccaataacagacaaacagagagccaaatcatgagtgaactcccattcacaattgcttcaaagagaataaaatacctagggatccaacttacaagggatgtgaaggacctcttcaaggagacctacaaaccactgcttaatgaaataaaagaagatacaagcaaagggaagagcattctatgctcataggtaggaagaatcaatatcgtgaaaatggccatactgcccaagataatttatagattaaatgccatccccgtcaagctaccaatgactttcttcacagaactggaaaaaactactttaaagttcatatgtaaccaaaaactagcccacattgccaagtcaatctgaagccaaaagaacaaagctggaggccccatgttacctgacttcaaactataatacaaggctactgtaaccaaaacagcatggtactggtaccgaaacagagatatatatcaatgaaacagaacagagccctcagaaataatgctgcatatctacaaccatctgatcttggacaaacctgacaaaagcaagaaatggggaagggattccctatttaataaatggtgctggaaaaactggctagccatatgtagaaagctgaaactggatcccttccttacaccttatacaaaaatcaattcaagatggattaaagatttaaatgttagacctaaaaccataaaaaccctagaagaaaacctaggcattaccattcaggacataggcgtgggcaaggacttcatgtccaaaacatcaaaagcaatggcaacaaaagccaaaattgacaaatgggatctaattaaactaaagagcttctgcacagcaaaagaaactaccatcagagtgaacaggcaacctacaacatgggagaatattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagatatcatctcacaccagctagaatggcaatcattaaaaagtcaggaaactacatgtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaataatgctgctataaggacacatgcacatgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaactggaaaccatcattctcagtaaactatcacaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataattaaaaaaatatatataaattgttgacataattttaatccacagcattatttaaattgtctagttcaagattattttgagaaaacaattaactgtggcaattctaattaaattcccttgatgtgtatattcgaaaaatatataaagcacagattgtaaaataaagaacagcattggaaagtttcaaaatatatatttttaagaaaagctaaaaaaaaaagaaaaaagagaggacaaaatttgtaatatatatatttatatacataaaacacacatatgtgaaaaatatacattgctactatagtccttgttcctgtaactggtcatgagattttagtcaatattcacacctttatttcttacacttctcttttctttgacttcaggctaaacttcagctgacctgggttcatttttactaggataaaccagatcttggttcttgaaattccgaatccttaatggccttaccagttttttgttgttgctttatttcttcatgaaatttttctgctagttatggaaattttaaaaggtcccttgaagaatctccagaattccagatattggtcattcttgcctccattgtggccaataccaatctcccttgtccccagtaccagtcacttcagccccatttttctctgtttgttcattaaaggcatgaagtggccaaattatccagctgacaatttctctaattcaataaagtaattgctgtgtttcttgataaaagcacaacatctgtgtaactaagacataaccacctgaattgaaaaatactgggacagaaagcaaacattctgggttttagggcaataaacccatttacagtaaataataaaaggaggtactgccatgcacatcctttgatttccgtaactgtttatttttgttcttattattatttttttaagccaaggaagaaacaatatcctattttggccaatacatccttcaggagaacctccaacttttcacttcgttgtctctgaattaacacttgaatgttcagtaagacatttcaccagggtatcaaaccagttacttcaaagtagtggggtatgtattagttttctagggctgccataacaaagtaacacaggcctgttggctgacacaacagaacatcattttccagtcagttctgaagtttggaagcccaagatcaaggtgtcccttggtcaggtttttccagaggtctttctcgttggctttgcagaggcctgcttatcactgtgtcctcacatggctctttctctgtggggtcacgtccctggtgctacttgtgtacatccaaattttcacttcttaaaaagacacaaatcagattcagttaaggtctatcctaattttcacttcattacctctcattttcacttaattacctctttaagagcttacctccaaatatacattctgaggtactggaagttagggcttcgacatgtgagttttaagggcacacaatactgataggaaaaaaatattccatgtccttatgtttggttactgtatggctcaggaggccaatttaaggatttgaactgccactaagaatggctatttcagctagggatttaggaactatggaaataaacaggacagtgagtgtacatatccattggggtcactaaaagatggacttgagcagcactaaatctacgaaaacaattttaaagaaatatacctaaaccataaaggtgcagaatggttgaaaagaaagggtaaatagctattgtgcaagtactaactagggaaagatggtatttgtattaatgatcaggtatatgtaccaatagtactgaggaaatttcaatacactaggaatttatgaaaattctaagttcatatcaacctagaagtttatagatttgatgggatctcatggacatatacagctcacttgaaccagagactctagggtacacatttcatttaagtacatacaagttactttaaaaaatactgcatgctatgctatcagcatgctatgctatcagctcaaatttcaaatctgtattacactaactttgtgacataatgcaacagctgatgaaaatgcaaataaagtaaatatctgcagtaattagataagtattttaaataaattaaaatttaaaaacatacattaaaacaccttagttggtaaaacaaatcataatagaaatcaattaattcttagaccttaaagagaacaaccatgctacctgtttaagcttatgcaggcttctgttttgagataaaatgtttaacttgtatctagaagtcctttacatagaaatatcccctagaaaagcagagcatatggtgggggtaaaaggcttgtgtgaggacataagagagatactgaggctgatgtttcgtgcccccttttgtcctttattttattttatttttccaggctggtctcaaaatcctgagctcaggtcgccctcctcggcctcccaaagttctggagttacaggtgtgagccactgcacttggccccttttttccttgagtaaagatgattttcagcagcaaccaggaggaagagagactaaacataacaaatgttggcagtagagtggagcaactaggaagtgccactggcggattctaaatttatataaccagcaaacgacttcagaagaaaattgactaaaattgagcatagagtttccacatcccagaattccactactagtcacaaacatacatatgtatacaaacatccatacaaatgtatgttcaccaaaagagacgaaattcagaaagaattatttgaaatagttataaactcttaataatatgtccatcaaaagtagaatgaataaatagatgatagcatatttatacagcaggaaggggcaatgaaataaaagaacactggccgggcgcggtggctcacgcctgtaattccaacactttgggaggctgagacgggtggatcacaagctcaggagttcgagaccaccctggctaacacagtgaaaccccgtctctactgaaaatacaaaaaattagccgagcgtggtggcgggcgcctgcagtccaagctacttgggagattgaggcaggaggatggcgtgaacccgggaggcagagcttgcagtaagccgagatcgggccactgctctccagtctgggcgaaagagtgggactctgtctaaaaaataaaaaagaacactgctgcacaagatatgcaaaatatcacaaatatattcttaagtaaaagaagactgaccaaaggagtagatactatatgacttaatctgcatagtgttgataataggcaaaattaatctgtggtaacagaagtcaacatagtaattatctttgggatttggaggatgagcgtcttcagggttgttgccatgtacttttgtgtagtttggatggtgatgatatgggaatattccttatttgaaaactcagagtgtaatttatgattgtacatttttctatatgtagattaaactttaatgaaagccttttagaataaaaatatttaagtaattgataaattactgcagcattgaaggaaaatttaaaacattaaatagctacactggaaaaacagaggctgaaatatgatgaattatgtccagcataagaagttggaaaatgaccagtagactgtacaaaaataaagaataggaaaaaataatataacatgtgaacgattgaacaaaatggaaaagaaacatttaatgttgcttttcaatatcaaatgtggacaaatttggaagtttattacatgtgcataacttcttacttaataattctaaaatcagaaaaacctttgtctgaatcctaatttttctcctttgtattggtagagaaacttaaccaattcaaggatacttatgaaattcatggatttatcagagtgtggacattcatgtatttttctgtggaaataaacacatatgacaatgaattgctactccagattctattagaatattacataatatatagtttatagaacgcagaattttttaaaatttgtaaaattctgaattggtgtaaacatccaaaacacatgtacattgtaaaggaaattagtggattttatttgagctgacaactaagataaacaaaatatctattcagactcatattaaaaagcacatagtgttaagaataaaaaatagacattaaagatactctagaaattgaaataatattttttaaaagtcactaaatagaaaattttaagtaaaatggaaaatttacaatatgtaattaaaatatctgattcaataattaaaataatttttgaaaatttcttcattctcttagactaaaacgtattagatccttattataaaacactaggcccaagaaattctatagaaagtttcagtaaacattcaaggaagtgataattccaatcctgtacaaactccttcagaaaataaggaagaaataggccatttattttacaaaagtagtatacacttaacatcataatcaagctagaaaggggattagaacccaatttcatgcatgggtatgaatgtgagtcttaaccaaaatattagtaaagtgaatccagcaatatatgaaaaaccctaacgcttcacatctgataagtttactaagagcacaaagtctttttctacattgtatatccactcatacattaaaggagaaaaaattatgtaatcccctcaaaagattttattaaaaatatgatagaaattcttaactaatgcttacaagaaaatttattacatttggtataggttgtataaaacaaataaatgagcatagtatttaattttgagaggttgaaactattctactcaacagaaacacattaagaatgtctattatctttgttctgtttatcattgcactggaggtcctagcaagtacactataataagcagaagaaataaaagcatcaagaattgaaaaaaatatataaaaatagtattcaaaaattatgtgcatatttatgtagaaaaagcatctggatatataatgaatataagggattattcgttgtattcagaaatatgaccagtaacaaaagccaaattaatttccaaatgcaagcagcaacaggaaaataaaactttaagtaaacacaacttatcatagaaaacacataagtgagtgagaatatgtggtgtttggttttttgtccttgtgatagtttgctgagaatgatggtttccagcttcatccatgtccctacaaaggacatgaactcatcattttttatggctgcatagtattccatggtgtatatgtgccacattttcttaatccagtctatcattattggacatttgggttggttccaagtctttgctattgtgaatagtgctgcaataaacatacatgtgcatctgtctttatagcagcatgatttataatcctttgggtatatacccagtaatgggatggctgggtcaaatggtatttctagttctagatccttgaagaatcgccacactgacttccacaatggttgaactagtttacagtcccaccaacagtgtaaaagtgctcctatttctccacatcctctccagcacctgtagtttcctgactttttaatgattgccattctaacttgtgtgagatggtatctccttgtggttttggtttgcatttctctgatggccagtgatcatgagcattttttcatgtttcttttggcttcataaatatcttcttttgagaagtgtctgttcatatccttcacccacttgttgatggtgttgtttgtttttttcttgtaaatttgtttgagttcattgtagattctggatattagccctttgtcagatgagtacattgcaaaaattttctcccattctgtaggttgcctgttccctctgatggtagtttcttttgctgtgcagaagctctttagtttaattagatcccatttgttaattttggcttttgttgccattgcttttagtgttttagacacgaagtccttctaatggagctcactgagcatattctaaaatatatgagatatattaaaggacattaaagccatgatactcccaaacagtaaaaatgggggggggattggatgcaataaatttgaggaatttcagggctgattaaggaaaactatgtgagcatgaatagatggtagcatgcaatgagctttattggaagctcagacagatttgcaagtgaggaaaattccctcacagcatgagaccatccatcagcactgcctagaatgggaggaaagcaagggaactgcaaggggagaggataagagaagaggtgtacaggcataagtaatatcaatcagcagcaaggtgaggagtctgtgggtctgagagctcgggggggaagtagtgacttgaggtctcgtaaccacaaggttcacctttttcatggctagctgatgttgggtgcagtttcatgaagtatgcaaagcaggctagctctaaatgactaaaaatctgcttttatggtctatgtttactaccattggatatataaaaagttgagttatggtgctgatggacttttgagctaatggttctcactctgctgtgaagaagttaacgacaaagaagaaaaatacggatgctatctttggctcatttatgcaacattggcctttgcagacaacaccatttattatatatatatgcattaaacagtgtcatattgcttcacagggagttaaaaattatgcagtgtaaaatgcatattaaaatcccagtgaaataagattttgccgtccccagtactgcaaaatttaaacttataaatgtccatgttttagcaaggatgttaaattatgagaactctcaagcactgcttgtgaatgtcaatttttgcaatctgtgggatagggagtaagtattaagttgaatgtattcattctctgtaattcagcaattcaagtatcatttacgctcatcatggatattgttacacatttctacctggagccaattctaagaatgttcacaacagttttgtctgaattagcagataaaaacaaaacaagacaaatcagttgttcaagaatagaggaatagataaataaattgcaggttatgcatagcacaaaacactaaagaaaaaaatgaactaaatgtttttatcctaatatgaatctccaaaaatataattttgagagaagaaaactatttacagaagattcaagttcaaaagcaggtaaaattagataatatattgttttagaactatatctatatctacatattaataggatatattcatattttatatatcaatatttatatatttacattaatactactgatataaaaataaacaggatatttataaatatgtaattcaatgagtagttacttctgaatgggaggaagggcatagtttggggaaggaaccttaattcatttaaaaagaacacataacattctattttatgaggttggtggtataaaataattcattttatatgagtctttaagctgcagccatatatataatatctgttttattttatatatgttataattaaaattataaaactcaattttgtgttgaaaaacaaatattatactaaaaaaagaaatagtgaattagaaaatatgctggaaaattctccagacaccagtgcaaaatgttaaaatatgaagatactgttcactctgatggtagtttcttttcctatgcagaagctctttagtttaattagatcccatttgtcaattttggcttttgttgtcattgcttttggtgttttagacatgaagtccttgcccgtgcctatgtcctgaatggtaatgcctaggttgtcttctagggtttttatggttttaggtctaacatttaagtctttaatccatcttgaattaatttttgtataaagtgtaaggaagggatccagtttcagctttctacttatggctagccagttttcccagcaccacttattaaagagggaatcctttccccattgcttgtttctgtcaggtttgtcaaagatcagatagttgcagatatgtggcattatttctgagggctctgttatgggagaaaattttcacaacctactcatctgacaaagggctaatatccagaatctacaatgaactcaaacaaatttacaagaaaaaaacaaacaaccccatcaaaaagtggttgaaggacatgaacagacatttctcaaaagaagacatttatgcagccaaaaaacacatgaaaaaatgctcaccatcactggtcatcagagaaatgcaaatcaaaatcacaatgagatatcatctcacaccagttagaatggcaatcattaaaacgtcaagaaacaacaggtgctggagaggatgtggagaaataggaacacttttacactgttggtgggactgtaaactagttcaaccattgtggaagtcagtgtggcgattcctcagggatctagaactagaaataccatttgacccagccatcccaatactgggtatatacccaaaggactataaatcatgctgctataaagacacatgcacacctatgtttattgcggcactattcacaatagcaaagacttggaaccaatccaaatgtccaacaatgatagactggattaagaaaatgtggcacatatacaccatggaatactgtgcagccataaaaaatgatgagttcatgttctttgtagggacatggatgaaattggaaatcattctcagtaaactattgcaaggacaaaaaacaaacaccgcatgttctcactcataggtgggaattgaacaatgggaacacgtggacacaggaaggggaacatcacactctggggactgttgtggggtggggggaggggggagggatggcattaggagatctacctaatgctaaatgacgagttaatgggtgcagcacaccagcatggcacatgtatacttatataactagcatgcacattgtgcacatgtaccctaaaacttaaagtacaataataataaaaaatatataaagatactgtttaaaatatgtagattacatggaataaccacatgtatatacaagtggaattacagaagttatgaaacagttatcaaatgagtaattttaggaaatcactttttaagaaaaacataattcagataattatgcatcaatcactggtatgtattgattatccaatgattgctaattgacataggtgaaaacaaaatgatttataatacactatagttaaatgtatgacattttaggtttgaagtgtataaactttcccttcatagctgtgctgagatgtgacccttattattgttctagtagccgcatactgagaataaatcagaagaaaattagcattattttgcaagaaaatagcttcaggtgaggttactgtagatctccatccagacaataaacagctgtccttttctgtaaatgaggaaatgactgattgtatttgcccagagccagaatttattttttgagactttcagagtcaacacccaatgttactacctcaattacagagtcttattttagagcccatttgttaacataacaaattgtagaattatgactcagattcagacatcaacaaaataggacttttcagtgcttgctcccatgccgaaatagcaattggacatctatccatgcatgataaccttcacaagagctaagaaaaccaggtgagagattccagcaattgggcatagcacagaaataatgaaacatgcattgaagagggcatgaaagagaattttatgttacctgtgtcacttctctcccaaccctaggcagcacggcttggaaagagataccctctgcttggagggaagagaagtaagtgagcaccaaacttctccttagacaataccaggtctgctccggtaaaagtcagcattggtcaggtccacatggccccagacttcaagctaacacctattgacagggcccaggcttgctgatgtgcctgactgcatcccacagccccaagctccaggccagcacagcagattcagtttcaaggtttacctcaggacaaggttggccccagtggccgcaggctccaaactgtccccactactcagccgacccttacaaccccaggtttccgccccattccaatgccaaatcagttctcatggcctcaatcaccagtccagcacctataaactctggcctttggcctgctcagtaagaagttggtccctgcaaccctattctctaggccaacctctgtggcctttagctccagctgacacagcatccaggcctgttgtagcagacacagagtcctagcccaaaccagaagatcccaatgcttggccagctcccaagaacatatgccccaaaaccaacctgtggacccaggttgctggttggccctgatggcctttggactcagactggctactgcatctctaggacctagacccaccctcatggatctagtctccaccatgagactcccataccctgcctccaggctgaccccatgacacaggctttatgccaatgactgtgtctctaggtaccgtgccatcatgattccagtcttcagaaatactccacagacacaggctccatgccttccaagcagcaggtcagccccaggctctgggcttgttctagcgcccccaggcttccgtgaccccaggggccaggtctattctagcagacctaggcactgggactacccactagacagtagaacctggatggtccccaccaaccaaggctccaggattactcattcagacccaggctctaagccagctccctggctgcaaaacataagcccacctctgtagacctcagatccaggcccactccaatatcaagcccattcccatggatttcaggatccaggctcagcccagtggaccaaggttccaggctcaggtgctggaattagcacctcaatggctcctgtagatgcaagttaaacaccaggtcagctcctgtggaatctccctggtcagactccaggtcaacaggtcctggagtccagtctggagtggatccagactccaggccaatgccatggacccagttgccagatctgttgacctgctgactcaagaaccagaagtctacctgaggaatccacagcaagtccacctgcagaacatgcaaaacagcctagtcagaatctctgaataggttgactggtcaagcctttctcagacaaagccactcttcaaagactgaaataaatctctacttcctcaaatgcacagacaacaatgcatggtcacaagtatcaagaacaaccagggaaacatgacattacaataaataaatacataactaactaactaaataaataaataaataacaaatacaaatgctagtagctaactctaaaataatggagatgtctgaactgcctgagaaataatttgatataattttaacaagatgggtgaacttctagaaaatactgagaaataattcaacaaaatcaagaaaacaatacatgaccaaacaagaaatttaacggattgaatttgaaaaaaagaacaaacaaattatggagctgaaaaataaaatgaacaaaagaaaaaatgcaaaagaaaaacattaacaaaaggattgatcaaacagagaatctgtgaacttgaaggcaggttatttgaaaatatacagtcagttaaaaataaagggaaaaatgaaaaggaatggaaaaagcttacaggacatatgggacatcatcaaaaaagcaaatttgtaacttgtaggagttggagggaaagagagagaaagacataaaactcatttaaaaaataatagcagaatatattccaaatgtagggaaagctataaatattcaagtacaggaaagggaaaagtctccaattagatgcaatccaaacaagatgatgcaaagatataattaatatgtctaaaatcaaagactgaaaatcccatattagaaagaatttagtaagaccagcaacaaatttctcagcagaaacctcacaggtctgaagatagtgggatgatagatttaagtgctgaaggaaacacacagacacacagacacacagacacacacacacacacacacacacacacacacacacacacacacaccccaaactaccgacccagaataacttacccaacaaagctatcccttcagaaatgaaggagagagaagctgagggacttcaccatgaccagattagtttacaacaaatgctaaagagagttcttcaactgaaagaaaaaagcactaactagtaacatgaaaacatatgaaagtataaaactcactatttaaagtaagtatatagccaaatttagaatacacctggactataacgatgatgtgtaaatcactgatatctttagttaggtttaatgacaaaagtattaaaataatagttatgataatttgtttagggacatataatagacaatgatgtaaatcatgacaccaaaaacaaaaaatgtgaagtgtaaattgaataaaaagactcacttcatgtgagtgatgttatgtttttatcagcttaagataccctattataactataagatgttttatgcaaacctcatcataaccacaatgcaaaaacctgtagtagatacatagaagatgaaaaagaaaaaaatcaaactatacaactagggagaaatcacctaatcacaaaggaagacaataagagaggaaaaaggaaccaaggatctacaatacaaccagaaactatttttaaaatggcagtaggtaagttgttatctaccaacaaatacctcaaatataaatagattagattatccagtcaaaagacatgacatagagtgtctgaatggatgaaaaagaaagaaaaagaaaaaaaaaaaaaacaaaacaagacccatctaaaagaaaaataccaagacccatctatcttctgcctataagagacacacttcacctataaggaaacatatacattttaaaatatgggccctttcactgtgtatattcctattgtgttgcttttttatttttcctaagactccaattatgtaagtattgaatcttctttgactgttgacatttcacttattttttgtctacccttttcctttctttccttatttttcattttcttgattgttttcctaattatttttggtatactttattaaatttatatttgtgtttagtctcccttttctactttgtaactgtgtcctgatttctcaaatggactatttcttcaatttgtttattaagtctgcccaacattgtttaggtataagccctttttgtctatttatattttattcaaaatgtttaattcaagatatttttaatacttaaaaatgcttgttaaattatatttaatttaatctgaagtgttatggtataatttccttctgcccgtttttgtatcattatattctcattggttggaatattttgatcttatttgctgactcccttcccacccttgtagttcattgcatggatagagacatttttgtgtgctattatagtgtgtatgtgtccctgtgtgagttcctgtgtatgtagaaagataggtatatatgtagtttgattgattgatttatacatagatgtctatatataggtagataaatgcagtcagccatactgtctatgagttccacatctgtgtatttaattagctgtagatcaaaaatattcaagaataaaattgcctctgcactgaacatgtatagatgtttttttctcagcattcttttctttttttaaaatttttattatactttaaattttaggatacatgtgcacaacgtgcaggtttgttacatatggatacgtgtgccatgttggtgtgctgcacccattaactggtcatttagcattaggtatatctcctaatgctatctctccccccctcctcccaccccacaacaggccctggtgtgtgatgttccccttcctgtgtccatgtgttctcattgttcaattcccacctatgagtgagaacatgcggtgtttggtttcttgtccttgagatagtttgctgagaatgatggtttccagcttcatccatgtccctacaaaggacatgaactcatcattttttatggctgcatagtattccatggtgtatatgtgccacattttcttaatccagtctatcattgttggacatttgggttcattccaagtctttgctattgtgaatagtgccacaataaacatacgtgtgcatgtgtctttatagcagcatgatttataatcctttgggtatatacccagtaatgggatggctgggttgaatggtatttctagttctagatccctgaggaatcgccacacgtgtgctggagaggatgtggagaaataggaacacttttacactgttggtgggactgtaaactagttcaaccattgtggaagtcggtgtggcgatttctcagcattattttctaaacaatacagtagaataactatttagatagtattagatgttataagtaatctagagataatttatagcatagccaaagatatgcataggttatatgcaaatactatgctattttatatcagaaacttgagcatctgcagattttcataaccctggaggtcatgaaaccaatcccccatgaataccgagggacaactctacatatacacacacatatagctgtgtatatctctatatctaaatacataaaaatacacaaaaatatttataaaatattacctccaacaaactttgttgtagtgagtgtgtgtgtgtgtgttttgttttaggagaatactcaatttacttgcattacttcctctttcttaaccattacaactctacagggcaatgtctttattctactctcctccttttccctggaaataacttttctaggtttttcacaacaagttttatacaatagctcggctttttttccctaggtaatgctgttttctatcaggccttgactcggtttttaatttttgttatgacagtagaattttcttattgattttatccatttgatcccactagtaggatttctatttcccttttctcttttctaagctgtctcttcagacttcactctacccacatggaattatgacattttcaaattcagttcttttcttctgaaaaatatttctctacctatagtcaactttcacttcatagggtcatctgtcttaaagtgatgcacaaatgtgtgattcatttatttactttctttgatctgaatggtttttgggaggatagatacaaagagtaacttttaagtgctgttattagcttaaagcctttttctatgtcttttctatggaatttcttatttatcttcatttcattgatatagatatacactaccataaaatgtattctggtaattgtcctatgtataccttctataataattttgctgttgtggtctggatcatccctgtattatttttaatggcaaggttttacattcttaaatgaaatgtcttattgtttagtaaaatattgttattaattattgcttttctcctgtcttcatggaattctatttgcatatttttcaacttttgttgactttatagtttttaatatgttaaaatatagtcatgttttatgactgctcatgtgtatgtgaaaactgtattcttattactggtatcactctgccctctagtgggtattctgtttttgccacttgcaacagaaaaatttattccctcagctactattcaggaggtggattttgtactactagactatatgaaaacaaattctaccaattacaattggctaagaattatacaacaattagacaataattgacttgtaatattgatgaaaagtaaaatattttgttctcattatgtcaaactaggataaaatttaaaaaaatttcttcatgcaagaaagaatattggactaagatttatttgtcaacctcttatataatttggtaggtttccttggaaaatcattgaaatattcaagttttggttaaccatttgtaatatttttgaaaaccttacaaacacatttggaaattctttgagaattaaatggtgtaaaagtttgatttgtaaacatatacttttgcaaaatgtaaaggaaaatgcaaaatgcaaacagtatgtgacatataggtatacttaatgcacgttgtgcacatgtaccctaaaacttaaagtataataataataaaatttaaaaaaatgtgtatgcggtttatgcataatatatgtatatgtttctgtattgcttgattcttctctgtatgtatatatgtctgtcctgtatcagcgagctatctatctacctatccatcatccgtcacccatctgtatttaaattagtgcttcccttaagccttctgtttcaaacatcaggcataaagaggattttgttgctcagaggcaatagctctgcatttatttctccccaagtccctggtaagcactaatttttttgtctctgtaatttgatgtttctaggtacctcttatacatagtatattacaatatttgccttttgtgtctgtcttatttcacttaacttaatgttttcatggttcatgcatgttgaattatctctccatggagagctctactttgagctactgtgaataatactgtgaataatactgggaagaacattggtacacaaaaaatatgtttgaatctctgctctcaattatttgagtatctattggaagtgtaattgctgggtcatgtgtattttcacgtctaattattggaggaactaccataggtttttgtagagcagcttcaccattttacattctcaccagtaatattcaaggagtccaattcattccatctcccctgaatcctgttattttccaacttttccttctttttctttgtttgttttttctttttcataattgccatcctaaagggtgtgaggtggtagctgttttgtttacttatttgtttgtgtgtgtgtgtgttattattgtcataagaccaaatacatgagctcaaacgttcaacagaattttaattttatgcagtatggttttaaaaaaaaaaactaaaagcacaatgttgtacagcagaactctagaactctagaatctgttcgtcttaaataaaggagctgctgttcattgtggttttgatttgcatatccccaattagtagtgctggacatgtttccacatgcttattggcatgtgtgtagcttctttgaagacatgtgtattcaagttctttgcctgtttttgaattgggctgtttttgttttgtagatttataggagtttttaaaatatatatattctgtacattaatcacttagaaatatgatttcaaaagattttatcctatattttgggctgccattttactctgttaggagtgttctttgaagtttttagtttttaattttgatgaagtccattatatatatatgtatgtatgtatatacatatattatatacatatatacacattatatatacatgtgtatatatacatatatatgtatacgtacatgtatacatacatgtacgtatacatgtacatatacatgtacatacatatattatatacatatatatgtatgtaaatacttttggtgtcatatacaataaataattaacaaagtcagtgtcatgaagttttttttctaggtcttcccctggcaaggtttgcatctgtatccccacaaaatctcatgtaacaccccagtgttggaggtgggacctggtggtaggtgattgaatcgtgggggcggtttctcatgaatggtttagcaccatcctcttggtgctgttcttgtgacattgagtgagtgaggtctcatgagatctggttatctaaaagtgtgtagcacccccctgccaccccatctcttcctcttgcttcagccacgtaagatgtgcctgcttccccttcacctttcaccataattgtaagtttcctgaggcctcctcagaagccaagaagatgccatcatcatgcttcctgtacagcttgcagaaccatgagccaactgaaccacttttctttataaattacccagtctcaggtatttctttacagcagtgtgagaactgactcatgtatatcctaagagttgtatagttttggctcttacctttaggtctttaatccattttaagttaattttttgttcattgtgtaagataagggttcaaatttctctggcaggaggctagttttctcaataccatctgttaaaaagactgaactcttcctattgaataatcttggcactgatgtgtaatacatttgaccatatatatgtacgtttacttctgggttgtctattctattctattagtctatataactttctttataacagtactttactgctttgattactatagttctgtggtaagtatgaaatcagaaagtgtgaaacctcaaactttgttttcctttttcaagattgttttggccttttagggtctcatgtaattctgtctagattttagaatggatttttctattaaaaatgtcattaggattttgatagagttttcactgtatttgtaattgctatggggagtattggcatcttaaaatataaagccttcaaatctatgaacatgagatgacttttcctttatttatgtcctctttaatttctgtcagcaacattttatgctttccagtgtattattcttttgtctgtttggctaagtttattcctgagtatttcattgtttttgaagcaaatgcaaataacttgttttcttaattttttggggtggggcttgttttttgcaagtatagaaatgcaacagatttttgtacgtttaatttgtatcctgcaatttttctggatttgtttattagttctaggagttatatttgggtaagggtgtttggaatctttaggattttctatatataagatatgtcggctgggtatggtggctcacgcctgtaatcccagcactttgggaggctgaggcgggtggatcacctgaagtcaggagttcaagaccagcctggtcaacatggtgaagccctgtctctactaaaaatacaaaaagtgaaccggccatggtggtgggcacctgtaatcccagctattcagaaggctgaggcaggagaatcacttgaacatgggaggcagaggttgcattgagccaaggttgtgccattgcactccagcctgggcaacaagagtgaaactctgtaaaaaataaaaataaaaaaaatgaaaaaaagtcatctgctaaaattctgattttcttctgtcaaatttggatgattttaaaaaacttttcttgcctaattgctctggctagaacctttaaaacgattttgaatgaaagtggtgaaagaaaacatccttgtcttattcttgaactttgaggaaaatctttcagtctttccacctttgagtattaattagcataggtttttcatatatcgctggccttaatatactgaagatgttttctctattcttagtttttttagtggttttattatgaaagagtgtgcacttttgtcaaatcgcttttctgcactaattgagaagatcaggtattttttcatttacactgttaatgtggtgtattatactgattaattttaatgtggtaaattgtactatacttgcattccaggaataaattccacttgccatgtgtttaattttaatgtctttttacatgctgttgagtacagtttgtagtattctcttgaggaatttttgcatctctatttgtaatgaaattaacaatgaatttcgagaatcactgaactacatatctaataaattaaaaaataatgcatatcacatttacttaaagaaaagtcgaacaggtatttatataagttgaataaacatttgctacctaaaatgaagctcacagtgcaatgttatataaaaaggataatataaaatatagctatgatatttattatataagctttgtatcagatacacactaatacatacatacacacatgggagtgagaaaacttgaaataaagaaacaattgagagtatttatctctggattgttgcccaatggctgtttttttttcttttgtacatttttgtattttcaggtattttaaattaaaatatattgtgtggttcaacatatttaagtttatgatgaaattattcaccagttattacaagaaattacatgcaaccaggatatcacatggggcattgttttatgtaattgctttatttgtggcctcttaggcaatacttcaattatattctctagggttaacatccctaaggcctttgtggcatatatatttgtgacacagtttggtgtcaggattcagtcttttggtaacatttttctctctgttatcactgagtttatttgaaaaaatcaggggaaaaaagtcattttcttgaaacatttattgaaatatattacaaactcctgcctgccacttttattgtgatttgcttttttttttttttttttcagttctccacaagaactttcctggagtccgttaatctttgcaaaagaagcgttagtaaatgaatgaataagtcaatttattctgtacttaagtgagttattcaattcttactttatataactttagaaggaaaagagtgtgttccaacaatctttgcaggaggcaaacccatatgtaaatctaactgccgttccgttaactaggaatattatctttcaccatatttattattattaatttgcctgtattctttttatcacaatattcttcttctttttatgggcacaaactttagttttaataagtaataagaattgtatgctatgttgtataatttgcaattacatgcattatgcctcggaataattcttagaaaaacagttttgaggtcaaggccaatattttataattttacagtttctaaaatgcctattacagtgctgagtgcatagcaaatgcacaatcggatagccatgctgggtgtcactacaaaagagggaaagcctgtgcacggcaccttgagccctcattcagctcaaaaagggtgacacttcctggggctaaatgggagattgtgaactttggccccaagtctttcagtcaagaaataagagtgtaggaagtgggttcaaaagtgccacacatagaaaagatgtttgggtaacaataagtcgaatatatattataaaatacatatctttgatggaaatgattttcttttcaggcccagtctgctcagagtttgttagaacatccttaggaaagaatacagatattggaaaatgcttgaaaaagtatgttcagttaggaaatttgcactcaatgagttttgtgtcaaactaaaacataagtttagaaaataacaacaaatgtagacggtcaaatcacaggtgtcaaatgaagtgaatttaaaggagcaattaaagaaagaaactgcatggatatgtaagttgtacataaaatacttttatatgtaaccctaaccctaacctatataaaacctatataattttctctatatataatcatatatatatatatatatatatatatatatatacactgcatgcacttatgttttctgcaaaatataagtgcgtgcagtatattctcttggagactaaacattgtaacaactcagtgtaaactatagagtgcttaatttcacctaatgataaagcatagaatttttacagaatgctgtgtggaatggtgttctttctatgcctactgctattttagctttcggtaagcagtcatgacatggttctggattaaactggcacaaaacagtaattgagttattttgaatgaactcagaacattttttaaaaatccaatacctcattttcccttctaactctccttgttttattctaattcaagatgcttaggtcccatggggtttcactatagctacttgttctgtaggactccaggtgtgcctcagtgcattgtgagtttacaatgtggtcctgatttaataggcaagtccagcttctttagtattattataaacttttaccccaatacatgtataatatgtggctagatttattcactcacatatacattcatttattcaatcaagattgttgagaatctactatgtcctagccttccatatttgccctcattaatattattttattgtagaacaacaatttgttgaaatggcaaagaagaaaacatgagtaaaatatatattatattacagatgttgcataatattgatatttttcagggcttatagttactgataatgacataactactatgaccatgatgaatgagtcaagttgagataaaattattggaaaagatgaagaaactaaaagtataggatataagaaagattatctgtgtctctattgtaagcaattcaatgcaaacaaaacaaaacaaaaatgtcctaaccaaataaaaaccattgtaattcttcaggaagtgatgtctcatctttgaagatttggagaactgaattttgaccacctgagaatgttgtggcagaaagtacttcagaataataaaaatgatctggatgtattattattgtttgctcccaaaccaaatcattctaaatatctgatattataatatatcaagaaaaggaaacagattttttcaataattatataaatgtggctgatcaagtgcatcattcacattatacaggaaggatctgaaatatgtggagataaatgtgtgattaaatgtagggaggtcattggaaagggaaattcagaaatagctatagaaacaactgttacaaaaatgtaatgatcattttactccatcattaatttcctttttagagttccaagttctcatcatttaataggtgaagaagtgaaaaaattaccgaaactcaaaataagcattgtattgaaatgaaataaaatggaaatgcttatcttcctccaagataagcgttttcactaaactctgactcatgcaaaaggtagactggcccttctcgtgaagccagttgcgtctgaggctactgaaccggatggtttaaaatataccagagccaacggcacttttgttcttcctctctcagttcccatattttattattacattgacatacattttatatgcactgtataattgtgatattagcaaattctagcttttgaaacaatgtaattgttgaaactaagcatatccataagtctttttataaataatcactaaacctctcaacatttcctcattttacttggccttgtccaaatatttcttcttgaatctctgaatcaacttccctattttgtcccagggaccaagaaaatcagacttctgaagtcaccttcatcctcttgggcttctcagaatatccagaccttcagacgcccctgttcctggtgttcctgaccatctacacagtcactgtgctggggaatctgggcatgatcatagtcatcaggatcagccccaaactccacacccccatgtgctttttcctcagccacttgtcctttgttgatttctgttattccaccacaattacacccaaactgctggagaacttggttgtggaagatagaactatctccttcacaggatgcaccatgcagttattctttgtctgcatatttgtagtaacagaaacattcatgctggcagtgatggcctatgaccgatatgtggcggtgtgtaaccctcttctctacacagttgcaatgtaccagaggctttgctccttgttagtggctacatcatactgttgggggatagtctgttccctgacacttacctagtttctactggaattatccttcagaggaaataatatcattaataactttgtctgtgagcacgctgccattgttgctgtgtcttgctctgacccctgtgtgagccaggagatcactttagtttctgccacattcaatgaaataagcagcctgcttcctatgctttcatttttatcactgtcatgaagacgccttccactggggggcgcaagaaagcgttctccacgtctgcctcccacttgacggccattaccattttccatgggactatccttttcctctactgtgttcctaactccaaaagttcgtggctcatggtcaaggtggcctctgtcttttacacagtggtcattcccatgctgaaccccttgatctatagcctcaggaacaaagatgtaaaagagacagttaggaggttactcattaccaaattattatgtctcatattataaaatctagaagtcgtacttattcctattgaagaatattgtgcagaactgcccaaaagttgtagaattgctaacaatccaaatccctttttcaaacagtaaagcagtgcatgtacttaatgtaacccctacttaactggttatttgacatctgttcaaattctagtagattagctaacaagtaacacagtaatttaatctctaatgatttaacttatcattaaactcagaatttgtcatgtaaagatttctgagttaatatacattaccctattgttgctcagttaaccttctgttctttttcagttgttggagaatgggcttgtagatttgttctgaaaaattatagcttaccatgaaggaagatatagcaaatgcaatacagtaaactaagacatgttcagcactcagacactaagtttaaaagtaatatttatttaattccacatagggcacattggtatattataaatgtgtataaggcgtaagtctgcccacaaagtccagaatatggtttggtaaaattgtattggttaacataaaattttatttgatcattgtacacaatatatcaaaaaatgaaaatagccacatattttagaaatagacattttgaaatctgaatttgtcattcactacaatcttgattttcatataagttataaatttgatccataacagaataccataaatgtcagtgatacataacattaggtaattattaattttttgtcaattgatttggcagtcctgatagtatcagctggtgcatcttggttaatattatctagtctaacgggtctaacgggaactcatagacctacataacgattgagtagctctgcctctgtatctatggtcctctgaaccattgggctagctggagtattttcttccagtgttgatgggtgagtcacaaggggaaatgtacaacaaaagctagttcaagcttccattcgcctcatgttttttagcattattttaggcaaagagaatcacattgctgggctcaaagttaatgactgaggaaggatatctgcctcttattgtagaattgaaaagttacgtggcaaataatgtagatacacagaggaatgaaggattctgcctactatttctatatatctaaattgttgggaaattttagttaatgggaaattatccttcttattccagataaatttttgtcctagtttgacaaaagtcttctgtaaattgatgagaaatttaatcgacttaactaaatgactgtttttgttgattgtcacttgctgttgatagttaatgtttaagaggaaagacaaagtcttggtaaatttccatatatcatggttcctgtattcctgactctcatgttcaaataaaaatggcaatttcctttgttataaagtttattataaaactatttaacctaatccatttatctgattgtttagcaatacataaaaatattttttaacaaatcatattatataactatagtattgcataacttatttaacttctaattgttcatcaaacagaggacatatacacttaagtaaatgttccagtcaagtacattaataggttttgtgtatgttaacaaaaacattttaagaaaaaagaaaaatgcatttagagaatgtgaaaacagtataaaatgaactatacttggcacattctaaaggtccttggatttaaaatcctatttgaaaaaaaaaagatagatattaggtaaattataatttgtaaactataattagctttctatattgtaggagaaaacaaaacaataactttgaagaaaacgggtttattacagtaagatggctgtgaacatttctgtcggaatctttgtaaaggcacatacagcacttttatttccttttacaagtacctaggaaagatagccgagtcatatggtaggtgtacatttaatttcttaagaagcttccaaatgatctttaaagtggctgtaccatttaaaatcctcctagctgggtatgatacttctgattgttccccatcttggacaaataactatatggtcattattttcaatcttagaaattcttacaagtatgtaatggtatcttattggatttgtgtttgcattcatctgataagtaattaagttgaatatattttcatgtgattattggttatttgtatttttttgataaagtctatgttcaaatactctgcctatttttaattgcaattcttttcttattattggggcttgataattatttatatattgtagatacaactcttttttctcctcaaatgtgtgatttgaaatatttctttgaatatgtggcttatctttcaccctctttagagtgtgttttgaaaaacagatattctggatttgtgtaataatgtatatagaaatgcaaagtaagtgaaatatccaaaaatatttttaaaagagaatgattggaggaattgaaggtttactgtaaaacaaaaggaaacaaaccagtatggtttaggtataaagacagacaaattgagactataatagaataaataaaatagaatccagatataatccaagaaacatataatcaattgatctttgaaaacatatctgaaaaaaactggataattgaatgggggaaaataacctcatttcctacctctctccatagaaaattaattcgatatttattatcaaattaattaaccataacagctgaaacactaaggcctctggaataaagaacaggtgattatctatatgaaaatcgacaaatgagactgtcaataattaaaaactgcctatcatcaaattagatcattataaaaagaagagacaacccatagattagaagtaattacctgtagactgggagtgtatattaacaatatatagagttgtcaattactaaatatatatatataacaaataataagaaaattaaattaaaatagactaatgtgcaattactttgtaaaaatatatagatggataataatctcacaaaaatattccaacaatatatgttttcaagggaatgtaaattaaatatcactatgattgcttgaagtttcaaaataatgaatttttttaaaaggcacaaatactagttttcaaaagttttcattccctgtggtcacatcatctactaaaatatcgctttccaaaacttttagatatatattttgaagtgttctctctagctttttttatgttctctatatctctatctttgctgcaagttgtatcagttcctcacagatgtcacaaaatttattaagtttctgtaatagctttttggccttagaaacacctttcatagtctggtgaagcatatgagatcttctttagaaaaacatttaaaaataaaatggatataaatgtaaatcaaacatattatatttctataaaattaccaaatattaaaaatattaactttatggacttgtataatatttgtgctttattattcatattagataatatctacatacatgcacattaactattataatttggaataaggatgatcatagtaatatttttaggtaggttataatatataaataataaaaatatatctgtgatttctatggttagagtattgctaacagtactgtggtttgtggtctaccttcataattaaaaacacactaaatttcagttagagttaaacaaaaataattatgagttttttccatattatttcatcataaactagcagatcatttaaaatacgttgtacactacgttgtataacagatctgtagaacttattcatgttgcataactgaaaatgcgtaccccttgagcaacagctcccaatttcctcctccccctagaccctggtaaacacctttctactctctgctcctatgagtttggctcttttagatacttcatataagtagaatcataatagtgtaggacattttcttgactctttcacaggtcttgcaacgggggtgccttgtttactcagtctgccctgctcaaccccttgctgaagggagcctgagagtgaaccagtacaggaactggagtgggcaagtgcagaaccagctgctttggtgccagcaggagcaaactccatgtgagccgcagggcagtgtccaggggccgtgcccgtgacccccaggccccagagggtgtgttaaaatgcttccttagctgtgctttctgcagacagccatgtgttaccagctcaacgggccctttgcctcatcacatgaggaaattgccttccaccagtaagggcaaagggccagggtgacaaaccttttaggtatccacatctggtgcatcctgaatttttgtctggtgcccaagacgaatgaggtcatgtggacgaattgaaagatggtgaatgtggagaattttattgaatgatgaaagctgctctcagtggagagggaggagctggaaaggggatgggaagggaaggttgctctcccctgaagtcaatccacctttctgactttcttttccaaagtcaagttgcttcatccagccactgtctttgaagtcaaagtcacctctctctgacatccagccacttcttcctgaggttcagccacttttcttctctgctagctgggtctggggtcttacaggcacaggatgggggtggggtgagccataggtagttttggaaaagacaacattcaactggtaaaaagacgttattcagaaagaaccaatcaggggagagcagacacatagggatggaagttctcacttagggccacgggtttcaggctgtttagcttgaaggtggggttttgccaaagacctgcccttgtctgcctagaatttctctgcctcctgtcattatcaataacatattagtacttctgttgctcatttatctaatttagcataaggccctctaggttaatttctgttatcacatatagcaggattcgcttctttttaaagctgaataatattccattttatgtatataccagattttttgtgtccattcgtctgtcaatgggcttttagattgtttccatattttgagtattgtgaataatgctggagtgaacacagtagtgtagatatctcttcaagatctggatttcagttcttttggttacatacccaaaagtgagattgctgggtcatatactaattctagttttaatattttaaggaacgttgatatgtttcccatggtggctgcaccactttatatgcccatcaacaatggacaagcatcctttatctccacatccttgcaacactaattattattattatgtttcatcatagccatactaaaaggtatgaggtgatagctcattgtggttttgtcttgtaattcccagatgactagtaatttcatcgtcttttcatgtacatattggccacctgtatgtccataatggagaaatgtctgtctaaatcctatgcttgttttaattggctatttcccttgtgttgttgaattgtaggagttccttatatatttcacatattaacttcttataaaacatatgatttgcaaatattttcttccatttcctaggttgccttttcactctattgattgtttcttttgctgtgcaactttttagtttgatacagttccactgacctattttcacttttattgtttgtgtttctgttgccatgttcaagaaataatggacaaaaccaatgtcgggaagattttcccctatatttccttctaggcattttacagttaatgaccctaaatttaattttttaatcttttttgagttgacttttgtgtatcatgtcagaagaggatctgacatcattcttttttttttttttttttttttttttttttttttttgagacggagtctcgctctgtcacccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccatgttagccaggatggtctcgatctcctgacctcgtgatcctcccgcctcggcctcccaaagtgctgggattacaggcgtgagccaccgcgcccggcctgacgtcattcttttgcatgtggatatccagttttcctaacaccatttgttgaagagactatcctttttcccattatgtattcttggtacatttgttaaaggttagatgtctgtatgtgtgtgggttatgtctgggctttctattctgcccaatggtctatgtgtctgtttatatgctagtacaatactattttatttattgcaattttgtaatatattttgaaatcaggaagagtgatgcctccagcatttttctcttttttttcttgtttcctttagctgttttgatcttttgtatgtttacaaaaattttagttttctattctattttgtaaaaatagaaaagaaatctagatctatgtgattttaattgacattgcattaaatcattacatatatttgagtagaattaacattttaacattaagttttctaatccatgaccatgggatgtgaagcataaaattaacagaaatatggaaataataaatgttaggaaagaaataaatgagataagtaatataaaaaacaatacaataaatcaataaaactcaggtttttaaaaaatataaacataattggccaaataataggtggaccaagaaaaaaaagagaagactcaaatataatcagaaatgaaagaggaaacattgcatctaaccgaccaatgctatagaaattaaggatcaaaattgactactataaacaattgtatgcctaaaaattggatgacttataagagataaaaaaaaatttttagaaatgtacaagctacaataactgaatcatgaagaaatagaaactctgaacagatcaaagactaataacaagattgaatctgtaatcaaaaacctcccaacaaagaaaatgcgggacaagacggtttcacttgtgaattctaccaaacatataaaaagtacaaacactagtctttctaaaaacattccaacaattaaagaagtgagaacactttgagactcattttatggaactggcattatgttgataacaaagacagacaaagatactacaagaaaaggaaaccacaggcgaatatactcaatgaacagattcctattgcttttctatctgtagttccttagttgtatcgtgtctgagacaccatcagctcttttgcccttgatttccctatgtgcgatatgaggtcctctgcaatggaacgagcttttttctgaagacacgtttaaaggagtgttgcatgattccctcttcctcacatgcaaaatacaactataacctcaaatgtaccatgatgatggcgaaacacaagtagaaaggaacatgagcccctgcattactaacatgtagcagagatgcccaatgtttaggagtgcattttggacctgcactagtgagaaataagtctttattctttaaaagcatgttagatagagtaccgaaattaatggatatatcatcctttccataaagtggcattttccataaactggtttatttttagaaacatgtaacccagttttttccagattcaacagtcagcataaacatctgaagatcatttagccatatttaaaaaggcaaacacaaattgttttctattaaaaaaaacaatagtgtgactaccaaatgaagtttgtattactaacaaaggataaataaaagatgtagcattatttagtcagctctgtatttcaacatataataacataaatatatcttcataaaaagagaaaataaattcaacatgaggtaatgatacctatctctggactattgttttatagctgatttttccctttcacatttgtattttacacctatgtaaagtcaagatatattcactattacgattaattaagtgaagttggtaagataaatgtcaagggctttagaaaggcactatacaaacaagatatcacatgggacagtgttatatctaattgctcaaatggtagcctccaaggcaatacttcagtgatattctctagtcacgaggtccccaaggccttgggggcaaatatttgtgacacagtttggtgctaggacttagtttctagatgtgaccttatctctgctatctatgagttttcttaataggttgggtaaaaaagtaacatttaaaatcttcaaggaaatatactctcgacactcctactgttgttttcaggtttgtttctattaattaagtgctaagcgggagcattattggagttcgttaatttcagcaaaagatccttcagtaaatgaatcactcagatgcctctgtatttaggtgagttgatttagtttttttaaaattttatttcagaaggaaaatactgagttccggtaatcttagtaccagacaaacacacgtgtaggttgaagtgccctcaaatccacttagttcattcaacaagcagaggacctatgttgttatatcctgattccttctccctttcaaatgatatcaattctgattttctcattcggctcccaccatgtactcagcaatgaaatcaatactttggcagataaagaagaataaagcaaaattggccttatctttaaactttctatactttctgaggagataagcgagactaataaccaaatctgtaaatgataggatatggtttatggtaactgtgagttataagcactaatgtttgcaatatatacagaggagaagaaacaatgagtaatctttacaagagtagatggtaaaataaagcattataaaagtgagaatagatagaaagcaaactttatgtaaatgagcatgtgctttataataacttgatacatctaccatgactttgagaaaaatgtgttagtggtaatgagattgagtatctagatctaagcagtttgggaaaatccagtctgcacaatgcagttttcatgcattcatcaataaaaaacatttggaattgttaaagtcattggctctcaggttaaagtgattacagaaaattattcttgcgatgttgcaaaggacatttcaaattgaggagagtgactgggaaatacagtcataatctagttttatagtgttaagatttttataaataattgtttcagggaaattgctgagtaattggtccttttggaagatatctttcctacaggcacaagcttgtgggaactagagaaagctattgtgtaatggaaaaacataaaggagaatggggaaaatatagttatgacttagactaaagccacaaataaaattctacagtacttccattttgtgggttcaggaaactgattctctgcattgtattcacaaatgtgtccacatgttgatagctgtcccatataggcctcatttcaataactacttaaggtttctgaaaccacactaattagctataattctaataaatataaaagtgaatatctaatatgctttatactgtgttttataaccactacattcattagcaatctttctgcttccattctactgatttaaattttatatcatgaatatattatcacattttaccattgaggaaatgccttgtggcatcaaggcatattgaaagaatactatggtgtcctgtttgagatgggtcttcctgacacttattcttggcaaagctttaaacttaaatcaaaaggacagaatgcaattttcctaaaaactaatatttatttgcagtactcagtactttcatgtttattattgtttgtcacctacctgtcttctgagatttgccacatcagaaaatgaaaaacttttcatttaaaattacttcaactattttatcactacagaaacatacatcacatattttgttgcaataatcttctcataagtgatataatacatcattaaaaataacatgaaaattttttcaagttgagttcaacatgcatgagaaagattagcatattagtgtaacacagctccagaatgtgttgaaagtattggattataaggaatgagaaaggtgttaaaaataaaaccaccaataaactgttaaatttaccattttacaggaatgttaacattttacaatttgttaagagttgtaagttaactgtctcaaagctttagaggtacagcaggaatgaaactgtagaaaagtatatatttcctccaacagaaatatttgcacttatctcagattcatgcaaacttagagtggctcttctcatgaagcctgctgtcttattatctgaaatataggaaggtataccctgttttgtttttcctgtcttaattttgttttttattattccattcacaaaataatcctattcaccttgtaatttttatataagtactctaccttttgaaataatttgacagtggaaacctagaattttcagcaacactcttaataaagacccactaagtctctcaatatttcttcctttctgtttcttattgcacatattggcttctacttctctggatcaactttcttatttttttctcacaggattcaaaaaaatcagactgctggagtcaccttcatcctcttgggcttctcagaatttccagaccttcagatacccctgttcctggtcttcctgaccatctacacaatcactgtgatggggaatctgggcatgatcatggtcatcaggatcaaccccaaactccacacccctatgtactttttcctcagccacttgtcctttgttgatttctgttattccaccacaattacaccaaaactgctggagaacttggttgtggaagacagaatcatctccttcacaggatgcatcatgcaattcttctttgcctgtatatttgtggtgacagaaacattcatgctggcagcgatggcttatgacagatttgtggcagtgtgtaaccctctgctttacacagttgcaatgtcccagaggctttgctccttgttagtggctgcatcatactcttggagtttagtttgttccttaacatacacatattttctgttgactttatctttttgtaggactaacttcattaataactttgtctgtgagcacgctgccattgttgctgtgtcctgctctgacccctacatgagccagaaggtcattttagtttctgcaacattcaatgaaataagcagcctggtgatcattctcacttcctatgctttcatttttatcactgtcatgaagatgccttccactggggggcgcaagaaagcgttctccacgtgtgcctcccacctgaccgccattaccattttccatgggactatcctttttctctactgtgttcctaactccaaaagttcatggctcatggtcaaggtggcctctgtcttttacacagtggtcattcccatgctgaaccccttgatctatagcctcaggaacaaagatgtaaaagagacagtcaggaagttagtcattaccaaattattatgtcataaaatgtaatgctagaaatattaattatttatccttgagagcagcactgcagttgttcaataactagtcattgcatgaaattatgataaccctccaactgacagtacaatatctattcacactgatgtttagtaaaataactttaaagttataaatactgtaagtatggaatctcagaccatttaaactaaatttttgatcgagaatattgtaatacaaaagtttttgtgttagtatacgtttattgtgattgtccaggtcaaatttcagttcaatttaaatcttgcaaaatgtaaaaatttttgagatgatctgaagaatagtagtttataatgaggaagtttacctgataacataaaattactatgataagagctgttcagtataaaacactatctataaaataattacaattaattctgtatgggcaactttggcattagaagatttacagacaaacaaaaataaataagaaaattatcttccttacgaagtccagaatctggtaaagttaagttatacttggtattataaattatatttttctttatgcatgataataagaagatggtaaatatttttgcaaataaatgcccatcaccctagttctgccactgatgccaatatgattgtgcatgttatttatttattaaaaattttattgagataattttctattcattttcctttgtaagaaataatatagaggaattccaattatcttttaaccagtttccccctaagatagtacaatataacaaccaggataatgatattgagataatacacatacattattcaagcattagttatgtattgataaaagaaatattcataaactcagtgatatctaacagtaagcaatcctttcaaataagtgacttgactggggtagctctgttgatatcagttcgaccatttgggtgtcaagaatggggtaactagatcagctacctttggaactagagacctgtatgtatgtcatcttctttggactctttggctgatagtctttgttgaaagcagagccacaatagagtattccaaaaataaaagcatacttaacgttcctgtttgggtctcacctgttaacattttatgagtcagagaaaatcacgtccaagccccaaagcaagagttgagaaagttatctatttcttgtagaactgcaagattacaagtcaagagtgatgggtacagggagaaatgaaaaactgggttcaaaattgattgaaacatttacatctttaaacacattcttccttgataatgccagataactttactgcagaaaacagataacccatggctctaattggttttagagaagttttcaaataattgaaataatttgattgccttaaccaaatggctggttgagattaagtataagaacttacattttctccttgtgtcttgccagtcatgattaaggcttacaagcacagaatatgaagtcaaccatgtgttgaaggtccaatccaagctgttaagtgatacttgtttcccctcaaggtttatctttatttccaaataaaaattcaataactttttaccttaatgctttacaccaacttacatgtctatgcaacttactgtttaggaatatacaacaaaattctcaacacttacagaatacagcaaaagtaacagaggatttactttaatttttaactgtagataatgagtcataattaaatgctctagtcgagtatttttaaagctgtgtgtatgtgtgtgcatatgtgtatagtttaataaagatgttaaggagcacaaaaaaggatttagaaagtttgagtatgcatcgcagaatatttagtatattcaataaggtttccaggataaagttagaatatactatttttaaatattgttttggaagatgtaagctgtaatttggtaggtttcttttagtacaaaataaaaatcaaagaaaaaaagaatagttgctaatccctttaatacaagatttttttattttggtaaatgttcataaatgggcagtttacacaaatataatgcaatttcccccccaaattctcaaattatactttcagtgtgaaagcaaacatgttaactgtgaagataaatacattttagataatgtaagtgagtttgctaatggtcatattaagtgatagctatgggctattttttttctacaaatacatttgtatgctgctcttcttttaaacttttggatacagtaggtataaatgtgacttttttcccatggagggctgtggcaggacatttgctatcatatgcacaatactaaagcaagttatatagtttaatgctcacttcttagtggattaacaactataaaaattatatctggaccattttatgtaaatgtcaactttcatattatgttgactaaacaaagacggcatcaaagattgtattagtgttggacaaatatatcattacgtgattatattacataacactttgcttacgtgagtggtttttactgctatcaaacataataggaaaacagagtccctataaagaaaatggaaacatatatgattgattaagaaaaggataaatatttgattcaatagtcagtatttcctgcttatggcattctcgatacatagaatatttaagctcaaggataccttgttggtaaaagttttcccctgaaacttgttgtcatgcagtttaagcaccaggaaaaaatcctaaggagagtaaataacaacaagcctgaacctgtggatctgagagaaccaaaattcaggaagaatttctggaggtaattcttggctattttagataacaacttataaacagaatatagaatacagcaatactaataacaaagttttcacataaatttcaacaatatatgaaacaagttgtatattattctaggaatttaaagtggatatatcatttaaatctcatcaatgaatttaccatattagcaaaataagggagaaaagcatatgtttatttcaatttataaagatatttattcaaatttatatcttgtattagtcaaaattctccagagaaatagaaccaaggggatggatatctgcttagctatatctatatctgtccatagagaggtatttatttattttaaagaattagctcatgcgattataaaggctgacaaatgctgagaacttcagggtaaattagcaagctggatcccaggggagccaatgatgaaattctagtctaatttggaaggcccaagaactagagagccaggggtgtatttccagtcagaaggtcaacagttttgagacccatgaagagctgatgttccagtttcagtctataggcaaacacctaatgtctcagttcaaaggcagaaagaggaaagaattttcctttgcttgggagagaagtagccttttgttagactcaggcatttactgatggacgcgtcccatccccattagcaaaggcaatctactttacttaggctactgattgatttagttgttaatctcatccaaaaacacccttataaaaacatccataataatgtttgactgaatatctgggcaccctgtggcccagttaattgatgcatacaattaacttttatgcacttgttcataataaaacaaaacagaagaaaacaaaagctcccagaaaaatagaaatagaaatgtcttaatcttttacctaccaaatctgtaggtaaatatcacaattaaggttaaaataatcggctaggtgcagtggctcctgcctgtaatcccagcaatttgggaggccgaggtgggcggatcacaaagtcgggagattgagaccatcctggccaacatggcaaaactccgtctctactaaaaatacaaaaattagctgggcgtggtggtgtgtgcttgtgataccagctgctcaggaggctgaagcaggagaatggcttgaaccagggagttggaggtttcagtgagccgagatcgcaccactgcactccagcctggagacagagtgagactctgtctcaaaaaaaagcaaaacaaaatgaaaaaacaacaaaaaagagaaaagaaataatagaagctttgttttaaatttcaactcaagagaagaatgttcattatttccacttctgtggaaaggttgttctagacaattgagtaagacaggaaaaaaagaacattagtgaagacagaataacactttcatgttttaagataatataattgtatgaacatccaaatccaaaaagatctatcaaaaccaattagagttagtaagggaatgtaaaagatctctcaatgtaagataattaacattttttttcctagatctgtgatatctgtctacatccttccacattgtattaatcccagcatccctcagctttagagatagtagttcttttctgcagtaaccactactgtggtatattaaggttttgtggggtttttgccttttcatcaattgtttaacaattgtaaaaataatttttctgtactaaatgttatgttttgaaatccctagaaaagattgtgtttttctcgaatagactcagactcttggtaataatgttctctgaactagaccttcaaatatgggtatctaatcatacacttggccgtgaagacagggctaagcatctttaaaatagaaattgtattcagtaatccatggtgtatagtaacgtggctaactaaataatcctttgtgcatgattataatgaagtgctcactgaatcaaatgcctggaggactgaggtgggggtttcacaaaactgtcatggaagtggtggtgattacaagaactgggatcttctgaatgcctgggagagcttgcaaaaagataataaaaattcagggcatccaaatgttggcataatttactgtcagagaactagagatatttaagacactgggcaagtgtcctcaatttcttagtgagaaactgatgtgtcagagatgatgtcttaaataaatcctataaaaatacaagtattcttaacatcagaaaagaattcttttgatcttgtgttctgcagaatgttgagatatcctctccaaagcaaatgacaacttagggcaatttgtactgcaattaagtgatttaaaatgtactgcgtctttcagttatggaggcaacacatatcacacttgagtaagctgtcgcaaaccattcaaaaagtaaccttcagcttgcctctcttgcataattccttaccagacactcttattgtcccacctctatcttttgaattttactcccagtgattgtggtagtcagccatacatggaacccccaatgatcccattctctggtattcacatcattgtggagtctcctcccatactttacctggcttggtctgtgtgatgaatagcatgtggtaggaatgagaatacataatacttgaggttcagtcttaacagtctggattctctctctctgtctttttccacctacattaggtctctcattcgggaggaagtggccatatttgaataaccctgtgaagggacctttgggatgaggaacctaagcttctggccaacagccttcaaggaacaagaggtgccagcaaccttgtgagtgagcttggatgcagaagtttgacattgtttaagccttgagattactgtagctctggaaggctggttgcaacctcatgggagactctaaacttggagctaagctgctcctggatttctgatgcatagaaaccatgaggtaatcagtgtttattgtttcaaactgcgaagttttggggatactttttagctgtcaatgaataattaatgcaactgtattagtcagttctcacacttctatcaagaactaccttgagacttggtgatttatgaagaaaagaggtttaattgacatacagttcacagggtgtacaggaggcaggtctaaggaggcctcaggaaactttcaatcatggcagaaaggtgaagaggaagcaggaatgtcttctcatggctggcaggagagacagagtaaaaggggaagtgtacacactttaaaccaccagattttctgagaactcatttaccatcaggagaacagcaagggggaagtccgcctctgtgaatcacctaccaggtccctcctgcaacactgaggatcacaatcgacatgagagttgggtggggacgcagagtcaaactatatcagtggatttttggtgcctgggaatatattgttgccaaataaaaacccaagatgttaaggtggctttggaaatgagcagtcagttttgaacaaaatatcattgaaatcttaatatgttttggaggtctttgataagattacagtttagagattccaggtgagtgagaaaaatattattggaagttgtagaaaggaatattcttgttatgtagggcagatgtttagtaatgctattgcctatagtaatttgaaaagtacaaaatgtgcctaatattctgggttatctaacaacagatattttctaagtgaaatgtttaaagttctacctggtttctccttgaagattagagtaaggcattagaggcaagaaacaaactaaattattaatgttgaaagatccaggatttgatggctatgaaatctcttagcctcccataatgggaaaagttggcaaaattaagaaatggtttccaaggatgatcaaatccatggcattgctgtgaaaacatgatttaaagatgaagtctaggatttgactataaaatcttaaaaaaaaatagaaaaacctcagaaagatctaaagtggtatctcagagtatattcacacaaaagactctcaaaagagattaaaagtgctccacctcctctatcaacaacaaggcttttaggaaccttaagtgtgccatctctgagccatctcatagaagcccaaggtagggaaagacttatatctaaaagacttaaggatgtgtttttatctctaatatagtggaattcaataagattcatagaagatccacaaagttcatttatgtatatatgtgtacatgtatacacacacacacacatatatacacaaacacacacagagagagagagagagagatcactaccttaaattgaaagacacagtgactgaaaaaaattgaaaggggcctatgagttatcaaaattctattagaagaaaacaagctaagaaacctgctaagttgcaaatatgtcccacatttcatgagaagaaaggatgattcagaccgtggtaccaaaagtccagaggtgagagctaaggaaccgagactaattaggctaattattcccagattttgcaatttaaccaaagaaatttctaaatttccctggctggacttcagaattccaatggatgagtaattcctttgcatatgttgaaccagaatgtttatagcaatatctcttaccagtaccaacattgtatgctaggtttatagagtaaccgttacttgtctccttagtttcataggttgagagaaactggacttgagaacctctaattaagacaatacatccatggagcttcctttatatttggtcctgatggtgattacatattgtcaactttaacaaaatgctgtggtggaataaggcatttgggcccttgggaagatttgagtgttttttttatgtggcgaagggacaagagtcattgtagatcagaaggcatcatgtagcatccccaaaatggcacccaataatttctactttcttgtaatgatccatttgtttgaaaggtccccaagatctgttttaatcaggtatggtaaaatatagagacattgacatgattgtgttaaaagaaaaattttattatacttacagatccctagaaagaggaggcatgacatgttccacagggctacacaaacaagcaccagggttggtccagaagtggaaggagtgaggggaaatatgacaagaattttttttttgagatggagtcttgctctgttcccaggctggagtgcaacggcacaatctcagctcactgcaatctctgcctcccaggttcaagcgattctcctgcctcagcctccagagtagctgggattacaggtgcttgccaccacgctaggctaattttgtgtatttgtagtagagttggggtttcaccatgttggccatgctggtctcaaacttctgactccaagtgatcagcccacctgggcctcccaaaattctgggattacaggcgtgagccaccgcgcccggtgaaatatgagcagggatctttacaaaggaactgctgaacggacttgcaattggctagcttgaataatttcagcaggcccttgtgtctagaggctttccctaggtgtctagtgcctggccctagggatgatttaggaaggaggataatggcccagagcatgagtgcctggtagaggaggtgacctgagcagtggttgtggatttgttagtttgcaactctagggtgagttgtttatcgtctctaagaattggcagaccatgggtgggcccatccctccagggttcacaaggcccaagatgtcaaagcatcagaatatagaacataaaatacacggttagtacccttgtgtagtcccctcctagattgggtaaccaatagcatactgcaaaagtgccagtgtgtcaatgggagattggctcacaaaggtctccagcttgtgtgttctcttgaatccctcatctggaataagcaaatagccatgctttgatctgcccttttgagaagcatgggaaggaaccgaagcttctggtgaatagccagtgaggaactgccaataatcatggaagtgagtataaaggtggaatctccaaccttattgagccataagtttaccacagttctgaagagactttcagccagaaccacccacctcacctgcttctgaattcctgatcttcataaattatggaagaaaataaatattagttaaataactaaaatactgtccaatctcttactgtccaaatcatcattgttttgcctaaggaatttttctgaagctcagtagttagatcatcgcaaaggtgaggcaagtgagatgtttgaggcaatgaatccaaacaaacagatctcattcaatgagtgataaaagttgatgtaaaagatgccagtgagggccaggtgtggtggctcatgcctgtaatctcagcactttgggaggccaagaggtgggcagattacgaggtcaggatatcaagaccatcctggttaacacagtgaaaccccgtctctactaaaatacaaaaaattagccgggcttggtggcatgcacctgtaatcccagctactcggaaggctgaggcaggagaatcgcttgaaccctggaggcggatgttgcagtgagccgagattgtgccacctcactccagcctgggcgacagagtgaggctctatctaaaaaaaaaaaaaaaaaaaaaaaaaaaaaattccagtgtgatctattcttgatgagtgattattagctatattctgtactattttccagactattctcatgagactaagcttcattgtcctgtagttgtagctgacttgtcagtgcatcttatttggttgtcttttctttcctgtttcacttacacatctactattaattagttttacttattaaataaattaccatattaaataaattacttattaaataaattatctgagcatgactgcttgtatctaatctgctttggggaaaataaaaaaaaaaaacacacacacacacaattttagttcaaaagaaatctttagctttggcccgggctacctgaaatgtttctctgatttgggtattttaagtcggcagattggatgatactcacagtgttagattccacaaatggaggacactacagtgagattggtaaactaaagcagagtaaagctcttcctcattgtgtgtgtctgtgttcttgttcctgtaagcatatgatatttttctctatagcaaaacctggttcaaacttcaacattgttaatcccctcaattcagcatatggctgtacttcctttaatttaatcatatggctgtacttcctttaatttgactgtatataataatgttggatggatgtaaaacaatccagattagattattattgagaatattttctttctctctctctgactattccattggagaaataaatttctcatttcaactgggattgctattataccttatattagtaatacctacaatattcatgtgtctttttgtgttccctcttgtgtttataccataactgtaagaagaccatgcccaggtagcctgctagtctcagaagaaagagaaacatgaggatcaggactaccctcagtaactcctcagctgcagtgtgtaacaaagccacatcagctgatccactgttgtgtgagcaagaaatgtatgctcaatgctttattgtgctggggtattataatttgcatatgtagcaataacttgatgatacagaacttggaattttgaagtgagatactcacctttgtgtgtgtcacacaaacacacacacacacacacatgcacacacaactctgagataggtaggctttgttctaggccaattggtgaatggcgagtgattggaagtaaagggggctattcaacataaaccaatgttttatatctttttataattaaaagttctttaaggaagtcaatggattgattttatatgtggttaaaattgtgtgtgtgttcacttttgtgatgttggtaattcagatgctatctgttttgctatatcgtgtgatatggatatgcagttattttacctccatacatccagaggcatgttctttctccatgtatctgtagtgtaatacctgccatattgaagtacctcttgataacttagtctgtttctgaacattttattatcttctactgtgtgttcatctgtttctacaatattaccacactgcattaattaccatatagtaaaactagtcttgacattctgttgaaaaaagcctcagggaatttttttttttttttgctctaggtacttactattcttggcctttcacactttcagaaaaatttgaggatgttcttgtcactctccaaagtaaatgacaatgatgataatgataatgaagacgatgatgacaaaaataccagagtggtatttttattggacagaatgaagtttattttgagagaatagatatatatttttccagtctttgaacttaatacaattctatgtaggtttgcattaaatcctcttaatatattttgatacacttatctttagagttactgacctacccctaggtattgaatatttgatgctatcataagtagtctattcttaaatatttcattctagtttgctgcttttataaagacatacagttgattttaatatatttgttttgaattcagaaacattacaaaactctcattcattttttttcccttatccatgttatctctacattactatgtattattatctgtgaaatgtcatcttatgaaaatgatgaccttttttgttttatctgtctatctattgatctatctgtaattgatccttgtttatatgcattattacacaactttagtggttaaaagttacagtacaatgattgacaaaataaagaaagctgtaaatatttatgatttcaaaagtaatatcttacgttttaatattaagcctgtttgtcctgtagttatttgaagctcctttatgaaattaagaaacatataattttatttgctaaggaagtttttacatgctttgatattaaattttaaaagaaatagttcttatgagtgtttatataatcaaatgcctttagtgttttaatatatcattgtttggaggtatttgaagtaacattatattattactaattattattattgtcatggaaaatttatctaaaagtttaagaaaaagacattgctcagacacttcttaggcctgaattcccctggatttgttattccagtttacttttatattttccctttattttctatcagggtcttttaggatactgttaacttttatatcttagaaaaataaaataatttctcccacttggaaaatttttttattatactttaagttctgggttacatgtgcagaacatgcagttttgttacacaaccatctgatatgtgacaaaactgatacacacaagcaatggggaaaagattccctatttaataaatggtgttgggaaaactggctagctatatgcaaaaactgaaactggaccccttccttacatcttgtgtaaaaattaactcaagatggatcgaagacttaaatgtaagacctgggaccataaaaatcctaggagaaaacctgggcaagaccattcagggcataggcatgggcaaaaacttcatgtctaaaacaccaaaagcaatgacaacaaaagccaaaattgacaaatgggatctaattagactaaagagcttctgcacagcaaaagaaactattataatcagagtgaacaggcaacctacagaatagaaaatttttgcaatctacccttcttgcaaagggctaatatccagaatctataaggaactgaaacaaatttccaagaaaaaaaaaacccatcaaaaagtgggtgaaggttgtgatcagacacttctcaaaagaaaaaatatttttatgactgtttcttaaatagcaattggattgggactatagactctttcttttaatatctctcttgcctggcctcttggatctcaacttttcttctgaaaaaaaaaattacctatagtttaactagttcatttttaaaaaattttctcttactatacttattttggtaacaaaaataacaaattatatcagtaaatctattctctcattgattacctgactgagaagagtttggcacctttcttttaaataaatctttaactttgaattggcagaaatttattgaaatatttctttttttagcccaagaaggtgacatgtcatccataattcagatctctatttaagcaatttgtttatataaagcaatttctcacgcctctattgatatagccacagccttggtttctgtttttaaaaacatgttcagaacttacgaaaataatgacttaaagctgtaatgaaaccacacattggaagattaaaaaaagttagtattatgtgcacagatcattccttaaccaaaacctgcatgcaactctgaacaaagtttgtagcattggaatttagaattgcaagataataatacacataatcaatacttttaaaattaaaacttgttgcacaaatatgcttgtgccaacatgggttttcattgtcttattcatttatttatttttaatttttatggctacataatagttgtacatgtatatggggtacatgtgaagttttgatacaaggataccatgcataatgattaaatcagggtaattgagatattcatcacatcaagcactggtcatttcttcttttaagaatgttccaatttcacttttctagttattttgaaatatacaatagattatagttaactacagttgccctattgtgtatggactactactagatcttattccttctatctaactgtattttggttagatataattaatctttgatcattaatcaacacctgtttatacaccactctccccactacccttttcagcctctgataacatttattctattttctatgtccatgagattgactttttatgtcctacatatgagtgagagcatgtaatatttggttttctgtgcctggcaaatttcccttaacttaatgacctccagttccatctacattgttgcatgtgttaatccgtttttgttctgttataaaggaaattgtgatgttggacaatttataaagagaaaggggttatttggcttacagttctgcaggctatacaagaagcatggcatcggcacctgcttctggttagggtcttaggaagctcacaaacatggtggaagtcaaaggggtagcagatgtgtcatggaaagaaagagagcaaggcagagaggagggaggtcccagaccctcacatgaaccagcagctcttgaatgaactaatggatcaagggcaccaagccattcatgaggaatccatcctcatgacccaaacatctaccactaggcctcacctccaacattggaaatcacatttctacatggaatttggagaggagaaacatccaaactacataaccgcaaatgacagaatttcattccttctgtgactgaataatattccactgggtgtttataccacattttctttatccattcattcattgatggatacaggttaattccatatcttggctattgtgaataatgctgcaatagacatgcaagtgcaggtatacctttgatatactgatttctttttctttggctagatacccagtagtggattgctggattgtgtattagatctatattttgcttgtctttacttttttagttttggcttatacactaagatgtctataaaacagaaaagtgaaaaaaaaacttctgtttctgagtgataatattttaaagtaatccttggcttagattctaaaattcttttcattgatttaatccctgacttgacttcaactggaatatcaggtaaaatgtattgatggaggtcggtcttagaaatttccaagcagatatttaatttttgctgcccatggcctattaaaaatagctcataatataaatataaaccataactagctgcttaaatttagcctatcaatttgtctaaatttttcaatactagctgcatcagaatttccaaaccttttgaatagttgtaatttctgtttccaaatgccactacacgtgtgcatgtctcaagacttcatggtcagtaaccaatgaggtggtatattattgggtcaatatttgacaccattttttttcttctctgatttgtgccctataggaatagattcagaaattacattacatggatttaaaatatcagtactatgacttatatggttatgctgaaaactataggtggatatacagtgcaattctgatacctaacatatccctattctttgaaacactagctcaaggcatgtttagactataacaataagccaacataattgaatgtaaaaatatgtacaatgtaatgttaaaaatgtttgtgtataaataaatgcatacacataaagcaacagaaaaatattttaaaagcatatcagctctaattacataggggttattagaatagtcatggttgtgttttttgttttatttttattttttcaagtttttcagtacagcctctatatagatgtatattattttttaagacatgaccaacacttagcaactcagaagaaattatattctaagttacagaagagaaagttttctctaattattttgtttatatctcatgacaatgaactgtcaggattctccagggtctgtgtccctgaagtcaagcagttagatgtaaaacaaacaaaacgatcacagaatgtggtctcaaggtctgtcccttcctcagaagcatctctctgctcctttcgacttcttgacagttggaaaaatgccatttcagtacttcattgaatcatattttgtaagaattaccaactgactgattgaaggactagaaaactttaaacaaaatttcctttttgagagagaaagtgtgtgaagctccttaatactaggaagaacaccttcaacaaaaggtgtatcaggaaaatccggcttctggtgagttggctcactgtagagtcatttcttcactttcacatgagtaatactggaatctggcacatttgtggcaggggagaaaatccatgtgagttgaataacagcaacatctacttagttcatggtttatattcaacagactaaattttatttttattacttctaggaccattgccctgaatttgaaaatataaaatctctacctgtatggtaggtacttcagaggttatataagagaggttgaatgtaagtcttgtcttaaagaagagatattcttcagagaaaaagctgaaagggccacacacacacatattagaaaaatattccatccgccatataaatattgttatggtatggatggagagaaaataaaagaagagaaaaagacattttgattaacttcaaggaaaaagacattttgattaacttcaaggctttcttggaagaattatgcaaatgatttctgaaataatgacacaatgtaaaacatgaaggagaaaggtggcatttcagaaggatagacagtagactagaagttataaatgacttgttttctaaaataaagatttaaaatagtgctataaataaacaatattatggtgactagatgatttggttatatagttcttggggatattatagaaactaggccaaaaaggttcaatttgatacatttgtataaactatattaaaaaacacttacattattgtattccaggcaaagagggagttgaaaaatgttaatcttacagatttgactacagtttgataggataattggaaatcttgtctctagatgagtagttgatgacagtggaaattgagcaagagggacattttgaagatttttttttctctctctctttattttaacatttccctaattgtctgtcccaaagccacaaacctgagtaggcaaaaaaagaatcagcaagaaccacacaggaatgcaatggtaaaatgaaaatgctacgtttgcggattgagaaacagatataattttgaatccaagattgagtgaaaactctaaaattaagggattccaggatataacactctttgaaaaatatctttttaaatttgcactgcaaagacattttcaaaacttcaaactgatgccatttttctgggaggtttacacactcaaaaattaaagtgtaaatgagctgttatctgtcaaggctttaccaaagtatagatttgtagccagatattttaaagtcataccctattagagagttccgtgctaaagattaaaggacctaccatgttgttatcgacatttcatacatgatgaagttaaggctcatattattaaacattttgctaaagttacatatgtcataagtagaaggctgaatctgaagtagcgggttccctttcctaagcccatattctctacaagatagcatgatgtgatgctaccattttctccataaatttagatcagcttccctcaataaagaaaataaccgttgagattagagtttctgattagacagtacagtgggaattttattgtttgctttgctaagaacaaggatataatttattcattcaatcctgggaatcctcccatgtatccagtgtaattaattcaaagcaataccattactactttgataacattatggctataatattatcttaacaattatagtctttattatgcacttttcagtgtctgttttgtctgtgaactaataaatatacaatatggacctggctttcaagataattgtgagatgggcgaggaagtgttgcatttattttaggtgattgtgaactcttctaggttttaaagcttcctataattatttaacataagttcctgttgagcacaacatatatattctccaggagttgagatgaaagaatgtttgatagagatttaatgaattgcccaaattgcaatagggcctataaagatggaacagactgaagaatagtaatattaattgaacctgaagaaacagtgaaggaattccagatagagagagtggcctaattaaggcaagtatctgtggttaagtactgatgcaattacaacaaaggattgaacaaacagtgaagggaagcaagaaaagagttaaacagtgcatgaaatataataataaatgcacagtcctaaaatctgtcagaaaattttaagtgcacaagcatggaggtgcagcttaccagtaataactgaggacaaagcttggcatggcaataaagtgacctaaggcagttcaattatttaacaacttctcagttaggcaccgttattagatacgtggcaaataaaagaagattgctgagttcattgcctcttggcatggcagcatactcttgggaaaatgaggtttacttctcagtgtcaatatcagctcagataatcaatggtatacttagaatattgagtaggttttctggcatatttagtaaccagggtgaggaggaaaatgaaaaaccacaaatgccctcacccctgagccccacaaaacaaacaaacaaacaaacaaacaaaaaacactaaaattgtttaactagagaggaaaagagagccacgtaaaatgtccttaaatatttaaaggactataatgtgaaagggttgagtcttaatttctgtgaattccagacataaagtttgatccatttgcattagaaaagtacccaaaaatgcaatagaaaaatatcagtatagtgaattttcaaacatagaactactaagatgtttactttcataataagtttcactgacagggtttgaagagagatcagtatacatgaggaaaaatgaataaaagataatacatatatagtacttgatgtatggctttatacacagacaaaagaaaaaaatagctattgttgctaaaatactattgcttatttttaatcataataacatggcaagaaatctggagccattgtagttttttaagaagagaaattaataagtaaatatgtacagaaaaatgattctggaatcagttaagaatagggactacagggagaaaaattgggggttagaaaatcagttgacaattgtaatattaatacaagcaagatataactaggttctgataaaaacaggtgcaagaattaacctttctacatctcagttttctcatctgtacatattggaattataataatgtcaaattgataacattgacataaggattaagtatgttaatatgttcaaagctcataacagttccttgcataagcaaatgctatatgtttattaaataaaattcaaacagatgagaaaatgtgagggaatgtactttaatgcaagaaagaagcactaaaaatattactaatgaggactgaagagaaggcatgggaaaatattcagaaatgctctttttttcttcttgccaagctttgtcttctcttggtttagaatctttcagaaaggacacttagtttccactagacagagtatgatctaaacattccaaggattatttcttcaatgcaagttctagaacctttagtgataaaatggcttaatctagctgtcttgtagtaataaaatattgtatctcaaaattcttaacttgtgtagttgtgacgtaactaaagtaatccaagttcctgaatgtaaaaacaagcctttttaatcaaagcctgtgactaaatgcatgaaattcacagaaggtccatccaatctcctatgtaacagaaagtgatcctataacagattctctgtgcctgggattagttatgatagatttgatagtaagttgtcatttgttacaaacaagaccagaagttgtggcagttcacagatgtgtccaagaaggcaacatcttatctattgggtctccaaatacatttacagaatgagtttgtggtttttattgtttgttttttagggttaaccatgtgaaatttataatgtgaggatgactattgctttacataaacaaaatgtttatatttttcaatcacacatattctgtcattcctcattgactaccacatctaagtttgtcaccatatcaagaaaaaatgtttggatgttgtaaggtatatttacttttttttagtacagccataagctagataatgatgtttcaggcaaatatggactgcttatatgatggtgagcccacaatattataatagtgccaaaaaattcctatcacctagtgacatcctagcatcataaagtggtagtgtaatgcattactcaaatgtttttggtgatgctggtgtaaacaaactttccgtgctgccagtcatataaaacctcagcatatgcaattatattcagtaccaaatacttgatactgacactaaaggatcatgaactagtttatgaatttaataatatatacttttatcatcattttggagtgtactccttccatgtattaaaaaatgttaactgtaaaacagacacatccttcaagaggtattctagaaggagacattgttatcttaggagatgacatatccatatatgtttctaccctggaaggccttctagtgggacatgatgtggaggtggaagacagtgatattgatgaacctgactctatgtaggcctaggctaaagtatgcacttatatattagtttttaacaaaacagctcaaaagtagaaaaaaaaaacaaaagcagaaagcgtcttataaaacaaggatatagagatctcaagatggatgaataggaacagctccagtctacagctcccagcgtgagtgacgcagaagacgggtgatttctgcatttccaactgaggtaccggattcatctcactggggagtgccggacagtgggtgcaggacagtgggtgcagtgcatgaggtgaagcaggctgacacattgcctcacctgggaagtgcaagaggtccgggaattccctttcctagtcaaagaaaagggtgacagacggcacctggaaaattgggtcacacccaccccaatactgcgcttttccaatgggcttaaaaaatggcacaccaggagattatatcccgcacgtggcttggaaggtcctacgctcacggagcctcgctcattcctagcacagcagtctgagatcaaactgcaaggtggcagcgaggctgggggaggggcgcccaccattgctcaggcttgagtaggtaaacaaagtggctgggaagctccaactgagtggagcccaccacagctcaaggaggcctgcctgcctctgtagcctccacctctgggggcagggcacagacaaataaaagatagcaataacctctgcagacttaaatgtccctgtctgacagctttgaagagagtagtggttctcccagcacacagcttgagatctgagaacgggcagactgcctcctcaagtgggtccctgacccccgagtagcctaactgggaggcacccgcaagaaggggcggacagacacctcacatggccgggtactcctctgagacaaaacttccagaagaacgatcaggcagcagcatttgtggttcaccaatatctgctgttctgcagccactgctgctgatacccaggcaaaaagggtctggagtggacttccagtaaactgcaacagacctgcagctgagggtcctgactgttagaaggaaaactaacaaacagaaaggacatccacaccaaaaacccatctgtatgtcaccatcatcaaagaccaaaggtagataaaatcacaaaatggggaaaaaacagagcagaaaaactggaagctctaaaaatcagactgcctctcctcctccaaaggaatgcaggtgctcaccagcaatggaacaaagctggatggagaatgactttgacaaattgagagaggaaggcttcagagatcaaatgactccgagctaaaggaggaagtttgaaccaacagcaaagaagtttaaaacttggaaaaaaaattagatgaatggataactagaataaccaatgcagagaagtccttaaaggatctgatggagctgaaaaccatggcacgagaactacgtgaggaatgcacaagcctcagtaaccgatgtgatcaactggaagaaagggtaccagcgatgtaagacgaaatgaatgaaatgaagcatgaagagaagtttagagaaaaaagaataaaaagaaatgagcaaagcctccaagaaatatgggactatgtgaaaagaccaaatctacgtctgattggtgtacctgaaagtgacggggagaatggaaccgagttggaaaacactctgcagggtgttatccaggagaagttccccaatctagagaatgccacaaagatactccttgagaagagcaactccaagacacataattgtcagattcaccaaagttgaaatgaaggaaaaaatgttaagagcagccaaagagaaaggtcaggttacccacaaagagaagcccatcacactaacagctgatctcttggcataaactctacaagccagaagagagtgaggaccaatattcaacattcttaaagaaaagaattttcaacccagaatttcatatccagccaaactaagcttcataagtgaaggagaaataaaatcttttacagacaagcaaatgctgagagattttgtcaccaccaggcctgccctagaagatctcctgaaggaagcactaaacatggaaaggaacaacctgtaacagccactttaaaaacatgccaaattgtaaagaccatcaaggctaagaagaaactgcatcaactaatgagcaaaataatcagctaacatcataatgacaggatcaaattcacacatagcaatattaaccttaaatgtaaatggactaaatgctccatttaaaaggcacagactggcaaattggataaagagtcaagacccatcagtgtgctgtattcaggaaacccatctcacgtgcagagacacatataggctcagaataaaaagatggaggaagatctaccaagcaaatggaaaacaaaaaaaggcaggggttgcaatcctagtctcggacaaaacagacttcaaaacaacaaagatcaaaagagacaaagaaggccattacataatggtaaagggatcaattcaacaagaagaactaactaccctaaatacatatgcacccaataaaggagcacccagattcataaagcaagtccttagtgacctacaaagacacttagactcccacacaataataatgggagactttaacaccacactgtcaacattagaaagatcaacgagacagaaagttaacaaggatatccaggaattgaactcagctctgcatcaagtggacctaatagacatctatggaactctccaccccaaatcaacagaatatacattcttttcagcaccacaccacacctactccaaaattgaccacatagttggaagtaaagcactcctcagcaaatgtaaaagaacagaaattataacaaactatttctcagaccacattgcaatcaaactagaactcaggattaagaaactcactcaaaaccactcaaatacatggaaactgaacaatctgctctggaatgactactgggtacctaatgaaatgaaggcagaaataaagatgttctttgtaaccaataagaaaaaaggcacaacatatgagtatctctgggacacattcaaagcagtgtgtagagggaaatttatagcactaaatgcccacaagagaaagcaggaaagatccaaaattgacaccctaacatcacaattaaaagaactagagaagcaagagcaaacacattcaaaagatagcagaaggcaagaaaaaactaatatcagagcagaactgaaggaaatagagatacaaaaaacccttcaaaaaatcaatgaatccaggagctggttttttgaaaagaccaacaaaattaatagaccgctaacaaaactaataaagaagaaaagagagaagaatcaaatagacgcaataaaaaatgacaaaggagatatcaccactgatcccacagaaatacaaactaccatcagagaatactataaacacctctatgcaaataaactagaaaatctagaagaaatggataaattcctcgacacatacaccctcctaagactaaaccaggaagaagttgaatctctgaatagaccaataacaggctctgaaattgaggcaataattaatagcttaccaatcaaaaacagtccaggaccagatggattcacagccgaattctatcagaggtacaaggaggagctggtgctattcctctgaaagtattccaatcaatagaaaaagagggaatcctccctaactcattttatgaggccagcatcatcctgataccaaagcctggcagagacacaacaaaaaaagagaattttagaccttggtgaacattgatgcaaaaatcctcagtaaaatactggcaaaccgaatccagcaacacatcaaaaatcttatccaccatgatcaagtgggcttcatccctgggatgcaaggctggttcaacatactaaaatcagtaaacataatccagcatataaacagaaccaaaaacaaaaaccacatgatgtagtagatgaagaaaaggcctttgacaaaattgaacagcccttcatgctaaaatctgccaatgaactaggtattgatgggacgtatctcaaaataataagagctatctatgacaaacccacagccaatatcatacgggtatggacaaaaactggaagcattccttttgaaaactggcacaagacaggaatgccctctctcaccactcctattcaacatagcattggaagttctggccagggcaatcaagcaggagaaggaaataaagggcattcaattaggaaaagaggaagtcaaattgtccctgtttgcagatgacatgattgtatatctagcaaaccccatcatctcagcccaaaatctccttaagctgataagcaacttcagcaaagtctcaggatacaaaatcagtgtgcaaaaatcacaagtattcttatacaccaacaacggacaaacagagagccaaatcatgagtgaactcccattcacaatggcttcaaagagaataaaatacctaggaatccaacttaccagggatgtgaaggaactcttcaaggagaactagaaagcactgctcaatgaaataaaagaggatacaaacaaatggaagaacatttcatgttcatgggtaggaagaatcaatatcgtgaaaatggccatactgcccaaggtgatttatagattcaacaccatccccatcaagctaccaatgactttcttcacaaaactggaaaaaactactttaaagttcatatggaaccaaaaacgagcccgcatcaccaagtcaatcctaagctaaaagaacaaagctggaggcatcacactatctgacttcaaactatgctacaagactacagtaaccaaaacagcatggtactgataccacaacagagatattaaccaatggaacagaacagagccctcagaaataatgctgcatatctacaactatctgatctttgacaaacctgacaaaaacaagcaatggggaaaggactccctatttaataaatggtgctgggaaaactggctagccatatgtagaaagctgaaactggatcccttccttacaccttatacaaaaaataattcaagatggattaaagacttacatattagacctaaaaccataaaaaccctagaagaaaacctaggcaataccattcaggacataggcataagcaaggacttcatgtctaaaacaccaaaagcaatggcaacaaaagccaaaattgacaaatgggatctaattaaagtaaagagttcctgcagagcaaaagaaaccaccatcagagtgaacaggcaacctacagaatgggagaaaatttttgcagtctactcatctgacaaaaggctaatatccagaatctacaatgaactcaaacaaatgtacaagaaaaaaacaaacaaccccatcaaaaagttggtgaaggatatgaacagacacttctcaaaagaagacatttatgcagccaaaaaacacatgaaaaaatgctcatcatcactgaccatcagagaaatgcaaatcaaaaccacaatgaggtaccatctcacaccagttagaatggtgatcattaaaaagtcaggaagcaacaggtgctggagaggatgtggagaaataggaacacttttacattgttggtgggaatgtaaactagttcaaccattctggaagttggtgtggcgactcctcagggatctagaactagaaataccatttgacccagccgtcccattactgggtatatacccaaaggattataaaacatgctgctataaagacacgtgcacacgtatgtttattgtggcactattcacaatagcatagatttggaaccaatccaaatgtccaacaatgatagactggattaagaaaatgtggcacacatacaccatggaatactatgcagccataaaaaatgatgagttcatgtcctttgtagggacagggatgaagctggaaaccatccttctcagcaaactatcacaaggacaataaaacaaacactgcatgttctggctcataggtgggaattgaacaatgagaacacatggacacaggaaggggaacatcacacaccagggactgttgggactgttgtggggtagggggaagaaggagggatagcattaggagatatacctaatgctaaatgacgagttaatgggtgcagcacaccaacatggcacatgtatacatatgttacaaacctgcacgttgtgcacatgtaccctaaaacttaaagtataatattaaaaataaaaaaataaaataaatgaaacaaggatataaataaaaatatgtttgtgtagctatacaatgtgttattttttaaggtaagaattattaccaaaaggtcaaattaaaaaaactagaatttataaagtaaaaatggtatagtaggcaaaggttattttattattggagaaagaaatttttaaaaataaattttggatagccaaagtgtacagtgttgataaattctacagtagtgtacataatattctaggccttcatattcacccactatctgcttcctgactcctacagagtagctcctgcaagcttcattcatattaagtgccttatacagaagtaccattttttatcttttattccatatattttactgtaccttttctatgtttagatatgcaaatactattgtgtaaaagttgtcaggtctctacaataggctataccatctaggtttgtgtaagtatactccatgatgttcacacaaagatgaaatcacccaatggcacatttcctagaatatatactcattgttgagcaatgtatgactgtagtataaattttgtggtttataattgctaaaaaatagagaaatttctgtttcatacaatatgtgctgcaaacaggctgcataactaacagaagataatctattgaaacttttaagaatatctacaaagcacattctcaggaagcggttttataacattgagtgttttgagccttatattagattggtgcaaaagtaattgtagtttttgtcactgaaagtaatggtgataaataactatatgatggctatataattgagggaacatattattagtggaatttttaatcagaccacttaaagattctcttaagtagatgttctatatatccatcataatgagataaacttggaacaggtaaaaatgtaatgtatcaatacagaactgtgaccatctgacaagacacaatacgccccccagccaaattttactattatgtttttatgtatgtttatcctttcaaaggactcttttgccacgatcatatgactactataatctgctcaatgcttttttgattttgctgatatgtttcctttgttgtcatataattatgttttaccatgagaattcattgctgtatcatataaatttacatacagcttgtgtacaataatattgataattactattttttcttgttttccagatgagggaacaaaagtgctgaaagacaaaactatttttccctaatcaaaaagactataaattatcaagtaagactcttagtgaagtcgaagaccttgaaaacacactaaccacatttgtcttcactcctttacatcaagcctcttctgggttcctcctaccctaccttctcaacttctgttgttacaactaatttaatttttctttatttttctctctttctgtctccatcacctttttctgtctctctctcttttagtgaagggccttggtaccagaagagagaaaccagagctctgtgaccacattcatcctgttgggtttctcagaatatccacacctccaggcgcccctcttcctggtgttctcgaccacctacactgtcgctctggtgggaaacctgggcataattgtggttgtaagaatcaatcctaagctccataccaccatgtactttttcctcagtcatctatcctttttggatacttgttattccaatgtatttacacccaaactgttagagattttggttgtggaagacagaactatctccttcaaaggatgcatggtacaatttttctttggttgtgcatttgtaatcacagaaatgttcatgttagcggtgatggcttatgacttgtttatggctgtttgtaaccccctgctctacacagtggctatgtctcctaagctctgtgctctcctggtaactggaacttacacatggggtggactctgttccctgacactcacttattctcttttggtgttatcctactgtggatctaacatcataaatcactttggctgtgagtactctgccattctttctctatcctgctctgatccctacttcaaccagatggcgtgtttagtcatttctatattcagtgaagcttgtagcctcctggccatccttgccttctatgtcttcatagttgccactgtcatcaagatgctttctacgggtggaccccaaaaggccatctccacctgtgcctcccacctgaccaccgtctccattttccatggggtcatcctgctcctttactgtgtgcccaactccaaaagctcatggctcctggtcaaagtggctactgtactttttacagtcataatccctatgctgaatcccctgatctacagccttaggaacaaagatgtaaaagagaccgtcaggaagttgataaactcccaatcaccttttcactcaaaataattcaaataaatgtttgtttatgtgtcctatgtccatttttttcatatacatgattgatgagagtttatatttaaatatatgactgtgtttgaagtccattacatattggatacttcacatttttcgatgttcaagatgccttaccattatctctagtttataacaatgtaatgcattctgttttaccccttttcaggagatttcagaaagaaatttatttcagtcttcccaccagacactggttttaagctatgctttaaaaaagtgcagcaactagaagtaataactgcctttagggagttactggatcaatattaaaggcctcataaccaactattttgacttagcaagttttgtaaagtacaagtttttgcttcaccttaacattttattctaggccagatgggaccttggggtttacattatgaaagatattaccttattttaagctaggagatactagctactatatttatattcatcactcatttttgagtaacaatgtaatatatcataatccaataaaagttgaaataatgctgaatatcaacaaaaagttcaatttatttctaacaatacttatattcattactgaaattgactcctttacagttctggaggctggaaggtcatattcaaggtgtgggcagggccacactccctgcagagactccagggaagctccttttcctacctcttccacccctggtgaccagaggcttacctcggctgggggtagcagcaccctatctccacctacctctatctccacagggccttcttccctgtgtttgtgtcactctccaaatcccactctcctttctaaatgggcacccatcactggatttatagggcctgcccaaatccattacggccatgtcttaatttgataacatctgcaaactcttttttctgaacaaggtcacattccaggtgccagggctaggacttgaacatatctttttggagagcacacgtaaacccactatcatgagtgaccccagacatggcccttctggtcctagatctcagtttcctcacctataacctgagggccgtcccaggaaaaaaaaacattatatatataatatataggtatatatataaaatatatgtatatatatataatatatatgtatatatataaaatgtatgtgtatatatataaaatatatatacacacacacaaatgtggtatatatacaaatgtggtatggtgtatgtgtgtatagtatatatttatacacaagttgacaacctggagagtaagatcttccttgaagggggattggtaacatggatcttcaaggacttctatacatatacatataatatatatacacaaacacacacacacatcacacacccctactcatacatatatacacacacacacacatacgtgcaatacacatggtatatatatggtatacatatatgaaatatatgatatacatgtggtttatgtgtatgtatatatatacacacctatatgtgtgtgtatatatatacatacacatacacactcacacacaaacctactcatacatacatataccacattttctttacccattcatcgtttgatgggcatttatgttgattccatatctttgcaattgtgaattgtactgtgataaacatacacaatgcaagtgtcttttttgtataatgacttattcgttttgggtagatactcagtagtgggactgctggatcaaatggtacatctacttttagttctttgcaaaatctccatactgtttttcataaaggttgtaccaatttacattcccaccaacagtgtatatgttccactttcacctcatctgcaccaacacctattgtttttgactttttcataatgaccattctggctggggtaaggtgatatcacattgtggttttaacttgctttgctttgatgattagcagtgttgaaattttttaatatgctagttggctgtttgcacatcttcttttgagaaatggctattcacatcatttgcccaggtgtactgggattattttttttcttgctgatttgtttgaattctttgtagatgctggtattagtcctttgtcagatgtaaaatttacaagtattttctcccattctgtaggttgtctatttattccattgattatttctcttgctgtgtcaaagcattttagtttaattaagtctcatttatttatttttgttttagttgcatttgctttgggggtcgtagtcataaattatttgcctaggccaatgtccagaagagtttctcttatgttaacttctagaatttttatggcttcaggatttagatttaagtctttaatcccttttgaggtcattttttatatggcgagaactaggaatccagtttcattcttctgccttttgttaaccaattttcccattatcatttattgactaggaagtcctttccccagtgtatgattttgtctgttttgttgaagatctgttcgttgtagggatttgctcttatttcagagttcctattctattccatcagtctgtgtctacttttatattagcaccatgctgtttttgttactacagccttgtagaataatttgaagttggataatgtgatgcttccagattttttctttttgtttaggattgctttggctattcaggctgtttttttagttccatatgaattttaggattgttttttctaattctgtgaaaaatgacattgtattttggtaggaattgcattgaatctgcatattgttttaggcagtatggctatttccacgatattgattcttccaatctgtgagcatatgggattttttttttcatttgtctgtggcatctacagtttctttcatcagggtgaaaactaattattttttcttgtagtgtaattgagatactttgggctttcatgtttctttttttttttttttaatgtttgtcctgttacatcccaccaccaggtttttttttatatatatatactttaagttttagggtacatgtgcactacgtgcaggtttgttacatatgtatacgtgtgccctgttggtgtgctgcacccattaactcgtgatttagcattaggtatatctcctaatgctaaccctcccccctcctcccaccccacaacagtctccggtgtgtgatgttccccttcctgtgtccatgtgttctcattgttcagttcccacctatgagtgagaagatgcgtgtttgcttttctgtccttgtgatagtttgctgagaatgatggcttccagcttcatctatgtccctacaaaggacatgaactcatcattttttatggctgcatagtattccatggtgtatatgtgccacattttctcaatccagtctatcattgttggacatttgggttggttccaagtctttgctattgtgaatagtgccacaataaatatacgtgtgcatgtgtctttacagcagcatgatttgtaaacctttggatatatacccagtaatagtatggctgggtcaaatggtatttctagttctagatccctgaggaatcgccacaccaacttccacaatggttgaagtagtttacattcccaccaacagtgcaaaagtattcctatttctccacatcctctccagcacttgttgtttcctgactttttaatgattgccattctaactggtgtgagatggtatctcattgtggttttgatttgcgtttctctgatggccagtgatgatgagcattttttcatgtgttttttggctgcataaatgtcttcttttgagaagtgtctgttcatatcctttgcccactttttgatggggttgtttgtttttttcttgtaaatttgttggtgttcattgtagattctggatattagccctttgtcagatgagtagattgcaaaaattttttcccattctataggttgcctgttcactctgatagtagtttcttttgctgtgcagaagctctttagtttaattagatcccatttgtcaattttggcttttgttgccactgcttttggtgttttagacatgaagtctttgcccatgcccatgtcctgaatggtagtgcctaggttttcttctagggtttttatggttttaggtctaacatgtaagtatttaattcatcttgaattaatttttgtataaggtgtaaggaagggatccagtttcagctttctatatatggctagccagttttcccagcatcatttatcaaatagggaatcctttctccatttcttgtttttgtcagctttgtcaaagatcagatagttgtagacatgtggcattgtttctgagggctctcttttgttccatcggtctgtatctctgttttgttaccagtgtcatgctgttttggttactgtagtcttgtagtatagtttgaagtcagatagtgtgatgcctccagctttgttcttttggcttaggattgacttggcaatgcgggctcttttttggttccatatgaattttcaagtagttttttccaattctgtgaagaaaatcattggtagcttgatggggatggcattgaatctataaattaccttgggcagtatggccatttttacgatattgattcttcctatccatgagcacagaatgttcttccatttgtttgtatccttttttatttccttgagcagtggtttgtagttctccttgaagaggcccttcaattcccttgtgagttggattcctaggtattttattctctttgaagcaattgtgaatgggtgttcactcatgatttggctctctgtttgtctgttatttgtgtataagaatgcttgtgatttttgcacattgattttgtatcctgagaatttgctgaagttgcttttcagcttaaggagattttgggctgagacagtagggttttctaaatatacaatcatgtcatctgcaaaaagagacaatttgtcttcctcctttcctgattgaatgccctttatttccttctcctgcctgattgccctagacagaacttttaacactatgttgaataggagtggtgagagagggcatccatgtcttgtgcccagttttcaaagggaatgcttccagtttttgtccattcagtatgatattggctgtgggtttgtcatagatagctcttattattttgagatacgtcccatcaatacctaatttattgagagtttttagcatgaagggctgttcaattttgtcaaaggccttttctgcatctattgagataatcatgtggtttttgtctttggttctgtttatatgctggattacatttactgattttcatatgttgaaccagccttgcatcccagggatgaagcccacttggacatggtggataagctttttgatgtgctgctggtttcagtttgcctgtatcttattgaggatttttgcatcaatgttcatcaaggatattggtctaaaattctctttttttgttgtgtctctgccaggctttggtatcaggatgatgctggcctcataaaatgagttagggaggattccctctttttttattgattggtatagtttcagaaggaatggtaccagctcctccttgtacctctggtagaattcggctgtgaatccatctggtcctggactgtttttggttggtaagctattaattattgcctcaatttcagagcctgttattggtctgttcagagattcaacttcttcctggtttagtcttaggagggtgtatgtgtcgaagaatttatccatttcttctagattttctagtttatttgcatagaggtgtttatagtattctctgatggtagtttatatttctgttggatcggtggtgatatcccctttgtcattttttattgtgtctatttgattcctctcttttcttctttattagtcttgcttgtggtctatcgattttgttggtcttttcaaaaaacaagctcctggattcattgattttttgaaggatttttgtgtctctatttcctttgattctgctctgatcttaattacttcttgccttctgatagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttttgtctttgttctcattggtttcaaagaacatctttatttctgccttcatttcgttttgtacccagtagtcattcaggagcaggtgttcagtttccatgtagttgagcagttttgagtgagtttcttaatcctgagttctagtttgattgcactgtggtctgagagatagtttgttataatttctgttcttttacatttgctgaggagtgctttacttccaactatgtggtcaattttggagtaggtgtggtgtggtgctgaaaagaatgtatattctgttgatttggggtggagtgttctgtagatgtctattaggtctgcttggtgcagagctgagttcaattcctggatatcctttttaactttctggctcattgatctgtctaatgttgacagtggtgtattaaagtctcccattattattgtgtgggagtctgagtctctttgttaggtcactaaggacttgctttatgaatctgggtgctcctgtattgggtgcctatatatttaggaaagttacctcttcttgttgaattgatccctttaccattatgtaatgaccttctttgtctcttttgatctttgttggtttaaagtctgttttatcagagactaggattgcaacccctgcctttttttgcttttcatttgcttggtagatcttcctccatccctttattttgagcctatgtgtgtctctgcacgtgagatgggtttcctgaatacagcacactgatgggtcttgactctttatccaatttgccagcctgtgccttttaattggagcatttagcccatttacatttaagattaatattgttatgtttgaatttgatcctgtcattatgatgttacctgattattttgcttgttagttgatgcagtttcttcctagccttgatggtctttacaatttggcttgtttttaaagtggttggtactggttgttcccttccatgtttagtgcttccttcaggagctcttttagggcaggcctggtggtgacaaaatctctcagcatttgcttgtctgtaaagtattttatttctctttcacttatgaagcttagtttggctggatatgaaattctgggttgaaaattctttcctttaagaatgttgaatattggcccctactctcttctggcttgtagagtttctgcccagctatcatcttgttagtctgatgggcttcactttgtgggtaacctgacctttctctctggctgccctgaacattttttccttcatttcaactttggtgaatctgacaattatgtgtcttggagttgctcttctcgaggagtatctttgtggcgttctctgtatttcctgaatttgaatgttggcctgccttgctagattggggaagttctcctggataacatcctgcagaatgttttccaacttggttccattctccccatcactttcaggtacaccaatccgacgtagatttggtcttttcacatagtcccatatttcttggaggctttgtttgtttctttttattcttttatctctaaactgctcttctcacttcttttcatgcagaaaggtccttagaggacctgatggagctgaaagccgtggcacaagaactatgtgatgaatgcacaaacctcagtagccaatgcgatcaactggaagaaagggtatcagtgatgggctttcacttttctaaaaaaaattttcgcatagtttttgtggacttagggttgaattataaccggatagatttacttgggaaaaaaatagcaagtttgcatcactgggttttgcaaaccatgaactttctatatctttctttttatttagatttacttcaatttttataaaaattgttgcatctctttttttctgtaaagttcttgcacacattttgttaaataaatcactgagtgcttgaagtttttcatgccattttcatgtcagttgtgatatatgttatttttagattttaatacaatttatttttacattgattttgcttctgacaattctattagaatatcttattaatgttataacttatttgtcgattattttgagttttcaacatatgcatcatattctcttcgattaaatgtaaactttttgtgttgttctaaatgatataccttttactggtttgtcttgtcttggttaacttgctaggcatctctgtattatgttgactaaagagtaaaattgggaatccttgaggtcttaacttcacaaggaaataatttttatttcatatttagaatgttttctgtgggttttctttttgtagattcctttttattttctaggttaccaacatggtttgcttcactttgtttattttcatttgtttttgttatgcttgttttttagtggatggtgatgtaataacccatactctgaataatatcatggaattttattgtcatactgttaaaaaagaaaaagcaaatattgatgtgtataaataatattattttattaatataaattcataaacacacaaaattaatctatatcaatatgtcagaatagtagtcacccttgaagtttactgactgggaggaggcatagtatgtgctgctgggtaatatttgataataactaatatgttaaacttgttggtttatgtacaagtttgttcactttattgagttgaactcttaattgtgcacttcgttgcatttaagttatatttcaattaaaataatctaaaagaatgaaagaaatgtggattccttggcagcacttagaaaaatccacatttttaagaaagtgttacagttagattccatgcacacagttcttgggacagcgtttggcacgtagagtattttttgtggatgaacagctaggtgtgggagtaaaggaaagggaatggaaggtacaaactgtctatatgtggatatgatgttgatgaacaccacacatatgttcatccggtgtgatgaacatcacacagatgttcatccggtgtgatgaacatcacacagatgttcatccggtgtgaagaacatcacacagatgttcatccggtgtgaagaacatcacacagatgttcatcaggtgtgaagaacatcagatgttcatcaggtgtgatgaacccaacaaagccttgccttatcctgtgggagctttggcacacatgtgacatacagtctctgaattgatccccttgggccagatctttgtatccatgcccaattagttagatgagcaccctggttccatgtagctgaagccaatgcggaagaagttgacaacctggagaataagatactccttgaagggggattggtagcatgcatatacatcttcaaggactattatacatataattactggtaagagtgcaaattggtagaattactttagagagtaatttgggaatagctaccctaagaaaatataacttatgacacagcaatattgtttctgaaaatttatatttaaaaagatcataaacatataaatttggatatatttgaagtattaattataacaacaaaagactggagactcttaaatgtccattaataactatttggtaattaattataacatattttaaaaatcacaccatacaaccattaaaaatactaagtcattttaatatatacttatattttacaaatacttctatctctaaaatagaatctttcaggaaaattgaacaaggactacacagtagtcataatttgaaatcatatatataagaagtacatgtgtgtgtctctattacatatgaacatgcaagtacattactatttcttaaggattcaaacaaatgaagacttggcagtggttactttaggtgggaaaacagagagtggcatgtggagat

SEQ ID NO: 485 - DNA, 109729 bp, Homo sapiens
ctttgagatctcaatttggactggcacatttcaagtgttcaatggacacatgtggttaatggcttcagtgtttagccaggcagtgcttgaatgtgggcagcacagggcctggtgcctgactctgcaggagaaatcacaggtatgaggtggctgaagatgcgcagcatgacagagtgaggccaaaaggcagcagtgcttgaagtttgagaacatgatgggggaggatgtgttcattttcctgcaggacaagtagcactgtgcaagttagtgcaagttatttgaagggcctcccaccatttcacagcaagaggggtgcatgctggaatgaaggaatcccaagcaccttctggtacaggagtcaaggttcttacaaaagattaacgagagagtgttttgaatgcatcaggaaatgttaaatgtatgagtccctgaaagggtctccaaagaattaacagaggtacttcatgaaaaagacttcttggaacatctgtcctacacagggcatttgacaacaaagaaagacacaaatgcacttgagctggggaggaaaaacattgatttcaagaataaattgaagttttggtatctgattgggttagagttttttgattcctgaaaataagttctatagtacttgaaagtaaacagaaagtcgtggatctgcccaagaggtcgttgaggggagaagaaaactctgacggtagttttgagaaaggttgtggagagagactgaatttttttttgtccaatttgatttattaaatcgaccatcatctgtgtgagctcgtgttgcaaaaatgacaacacagatcatttaaatgctttgtcgttcacatctctactcggcagcctgacgctgacaacactgccaggcacatgaagcaatccctccaagatacatttcagatattaatgttttggtattgttaaatcatattatttttatttctataaatttatcttgttccccatgttaatggcagaaagtttcaagttaaaatcaagggtaaacacattggcttaggactctgtcttcttctgaaaggcctaagccaggaaggtggatacaattgaaggaagccaagagaaattggttagcctgctactggctgcaaagaatagaatcccagaggccaagtatctaaaatgacaatagtaacttctcccatagctaagactcacgtagggtgaatctcatggctggttgatactgtgactcaatgacatttaggtttttacacaaaatatttcttcactctgctatcttttgagctagtttcctctttagaatggtagcaagaaggctatgccagatctaagcagtatacttatgggcaataatacccaggagaagaaagagtcacttctcaggcttctctttctctctctcactctttttttttttttttttttttgagaaggaatctctctctgtcgcccaggctggagtgcagtggtgcaatctcagctcactgcaacctccacccactgggttcaagcaattctcctgcctcagcctcccaagtagctgggattacaggaacatgccgccacgcctggctaattttttgtattttagtagagacggggtttcaccatattggccagcctggtcttgaactcctgacctcaagtgatcctcccgccttggccttccaaagtgctgggattacaggcatgagccactgcacctggccgcttctctctttttctcaaatttttctgacagcctctccccctgtctcattgtccacagttagatcacatgtccattcctgaattaattactgcaagggaaatagagaccaacgagtaaatctatattccaatgagactacccctggagttgaggttcatgactatgagaaggaaagatggatatgtggacaaaattagattctattaaaaaaagaaagaagaggcaatgaatgtcaggtaagcaccaatactattcaccaaatatcctatgtaggtttctaatccaagtaaaagcatgcttccaatggatagagatctaccacatactctatgacaaacgtctaagccaaaccaggttgtccatgtgaacacaaacctattactgaaactgcttcctggataatatcacattaaattaaaacttggatcatgaaaaggcttttgcaaagacacagtatttcagtggagggacttcgtaaaacaaacaaacaaacaaacaaacaaaaaccacaaagttctcccagatactcaactgagttaatcttgcattggatgtccacatttaatgtgtcacattggagtcttaaagtaccttctgctagttgtgtcagaattttgcttcagagtaggatataaaaagaaaaaatatcttcttataaatgtgattgtttttctgcctttgttataaatgaaaagttatgaacgtttcaagatgtactttctttttaagcagttaactgtcagtttactgtagctgggccctgagacagagataaagtctttataaaacctaaaacaattttagaagattattcaaacttgtgggtttttacacatatttttccagcattaatttgtttctatttttcttggagccgtaatgtatggttcttgcttttccagtacactacctgagtataacagtatggttagaagtttcattctaacagatctgttattctacatggtgatagcaatggttaatgccagactagtctccatacaaatagtacttgaggaaaattttctcttctttcattggtagtttatattaatattcttcaccttgaatgccaaatttagaaaaaaagagaaacctcagaagaaagacactgttttctcccttttcttaggatacatattttgctccatagtttttcttggtcaaatggttttcttttaagttctcttctccatctttctttcttgtttactccaggaatgcaaacttgatcttgactttaaggtcaaagcattttcagaatgtgcagtcagcagagaattgaaaaaaaaaatcaatgtgaaacatattagagaagaataaggggaagagtgatgcagaagtgctgggaagtcatgcagggattggaaaccacaaagattctacagaaagtaagaacgtcctgcaccgagatgtttatgattccttttgcttttacttcccttttcttacataggggtaggtgaaaattatggtaatttgaggtctggaccactttcaaagcattttcaggggatgaaaatgacttttgacctctaaaaatgagacatgtttctttttttttttttcctgaaacccttttttcttttcctgttttgttcatggtaggggagatgactatattccatacctgttatgcacacaaacttagaagggtttattgcagctccatggctgaaaatagcaatgaaaattgtgagaccttttatgtcagcattggaaataaacttaattttaaatgagaacacctttgattttataaagagacttatccagtgtaaaagctggaaagttaaatagaatcatagtggaaatgttgattctaaaattctagtatctagccacagaccttgaaaagaagaaagaaagctagaaagatgaaagaaagaaagaagaggccgggcgtggtggctcacgcctgtaatcccagcactttgggaggccgaggcgggtggatcacgaggtcaggagattgagaccatcctggctaatatggtgaaaccccgcctctactaaaaaatacaaaaacaaaaacaaaaacaaaaacaaaaaaaacaattagccaggcgtggtggtgggcgcctgtagtcccagctactcgggaggctgaggcaggagaatggcgtgaacctggaaggcggagcttgcagtgagctgagatcgcaccactgcactccagcctgggcaacagagcgagactctgtctcagaaaaagaaaaaaagaaagaagaaaagatcaattgtcctttatgacaaggattatcatctctttccttatttatcattggactcgagaacaaattagatatagaaaaaaatcccattactttgtgaagcttaatatttactgtaacttactgatctagagaatgatcagagaaaattttaacttttatatatgtatacatattctgtatgtatatgtaaatgtgaaaagacaaacaggttcttaatcatctttccatatggctgatttaaagtaattataaagccaaaacattactgagttatctggaaaatatgaaatgttctctcaaacattaactatattaatattaatataatcaaagattaatattaactatatggcaaattttctaaaaatctaactaatctaaacatttgcactggggatagacagaactgtcttattacagatttctagacatatatattatagatgattatgtttagaataaagcatttgttaggtaacattctttcactgtttgttacttttgcactgacctcacatacttaaattttataacagcacaacaagaatgtgctgagaacagagcttggcataagctcattgataaccgtgagtgtgaattactggcagaaatagatattgatgatttagtccgtatcacagtggaaagggaggaaaattgaaaagcttttttttcactctttagaaacatttgaaatcattccttggaaaagaaaaatctatattaggggctgagtaggggaagatacaggttgagtcattaatttgatcagtacagtaagttcaaagattgtttccactacaacatctcatctgaaattttacagattcccttaaagggggccaaaaaaaaaaaaaaaaagatagtgatttctaagctgaatcaaatatgtgcactttacttcatggaaaatcagtagggaaacaagaaagattctctctgctaacatcgattttccttatatttattttttcagtcggaacactctaggcaaaaattcacttggcttcaactaatttgcaaatgccatcattcactgctgttttgctacccatttctcaaatctcaattaaatgtgatgacagtttacttgccagaaacacacagaaaggttcttttccaaccagaggtcttcactcatttcctgcttgtggacttggcaagtggggtcaaaacatccattactgaggctgaatcttaatttagaaggttatcaccagagtcagcaaaataattataaaaatactttccaaatgcaaactgcaatagacatgcacagtaacagctgaaaacaatatatacatcataaagcctgtttacaatggaattttaaaagggtgaatgtttggtttgtacttgttgaaagcttgtataactcactcctaggatggacccgaaactgtcttctctctgcaactattctttacattaaaaccaaaaataacaacaaaaaattacgctacaagtcttgatgttctggctcagacaccaaattccctataaaactaaaagtgaagggtgaggtgagacaaaattttggcttaaagaaacaccagttgagaaatgaaagaaagtactgctcacttttcccttatttcttctatgtaaataagtttcctcatacaatttatatagtattgctttaaatatatgggatctttagaaatcatagaatgttaaaaatatcaatatgtgtaaatgggtactcacttcacataataggtactcaataaatattagctacaaaagataaaaacaaactataagacatctttgtagagacaatttgctcaaccttcttctctctccctttttttttttctttttgagatagaatttcactcttgttgcccaggctggagtgcaatggcatgatcttggctcactgcaacctccgcctcccaggttcaagtgattctcctgcctcagcccccgagtagttgggattacaggcatgcaccatcatgcccggctaattttgtatttttagtagagacagggtttctccatgttggcgagactggtctcgaactcccagcctcaggtgattggcccccctcggcctcgcaaagtgctgggattacaggtgcgagtccctgcacccgaccaaccctcctatttatagctgaagaactgagggctaagtggttgaaagacttgcacagctcctacactggcctgctgaaagccagggctgcaacgcatttcttctcacaggttcagagactcctgtacctcatcactgttacagaacctctctgggcctcagttcatcatttgataacaagagtaactcaacctgcccaggggttatccatcaaaggcaatcgaggttgcaagaattcctttaaaattttaatttacagtatagcaccttgcaggtagcaggcactccataaatctctgaggaatggaatttgctgaagaacagtggcaaaggctagctctgattcattccccaaagctcatggtgcttgtccaaactgtttaatcaggcttatgcaaccaactcctctgacctttattacggggtgggtgcaatcacatgcgctgtgggaggaggggcaggtggcctcggcctgatcagggagcactagaatggggacaacattttctattgttcagaaactaaaaggactctgcttgaccccagtgtaagcctttcactgcagtagttgggagccaagctttctcttccaacctatctgtcctggcgatcttcattttctctgtttttttcctaagacagaaatatcagctagaaggcatttccctcactggattcatccagccctgatgtgagagtgctgggggcagactgagatcatgtgtgatgcctgtcaggctgcctgccaggccatgtatattgttttggtggactggcttctgcaggaacatagagaagacatgggaatagattctgaaaaggggggtgggggacaggaaaaaatgccaaaagcccacttaatactgaaaagtcttacacttccaagtccttgttactgctggccagagaatgggttgttgccctgtgtttttttttttttttttttttttccccaggaaagctgccacggcttttctttattcaataagtacatgactgcatttggtgaattgtgtttacacgttctggtgaaatgagattttaaaaagaaaatgaatcagggagtgtttttaaagagcacagagtgaggagaggaggtggggagcgctgctgccagtcctgttctgttctctgccttttgtcatccttccccctctgtatctctctcctccatcttctcctccaaggaatcactatgctcctggcaggacatccctggcgtctgtcaggggagagaaggaggaggagaaataggagaaggagaagagaagaaaaaacaaaagagaagaaaagaacatcacaattgacgttggagagtgatctgtgctaggaggagttcatctctgcacttccccattggaatgacagtctcaactttaccccaactagccccccaccttacatgagctgtaggatcgacgtcgaatctcttggcctctctgagcctcagtttcctcagctattagatgaggataatacctgtactgtttttgccagagtggttgtaagaaagaaatgagaagcttacgaaaccataaagcatgatgccagtcaaaaacatatagtgatttatatcttaaaaagatttattagtcctggcacggtggctcacacctgtaatcccagcactttgggaggccgaggcggggagatcacgaggtcaggagatcgagaccatcctggctaacacggtgaaaccccatctctactaaaaatacaaaaaattagccaggcctgggggcacatgcctgtagtcccagctactcaggaggctgaggcaggagaatggcttgaacctgggaggtggtggttgcagtgagccaagattgcaccaatgcactccagcctgggtgacagagagatactccgtctcaaaaaaaaaaaattattaatattcattatttattttagagacagagtctcgctctgtcgcccaggctggagtgcagtacgatcacagctcacagcagcctcaaactcctgggctccagcgatcttcctgcctcagcctcctgaggagctgggactctaggcatgtgccaccacccccagctaattttttttttcttttaagatatggggtctcactgttttgcccaggctggtcttgagctcctggcctcaagtgatccctctacttttactctcaaagcactgggattacaggcatgagccaccatacctggcctaaaaatatacagtaatttataattttatttctattttctcttacaggataatttataaattgagtgtgtttagatttccccagcatatgggctcaggtgatttcacatttagagttaaacctgaattttgcagtcgataaaagaacattttgttggctgtaagctcagctcattcacacaggcatgtctatccctgcaaagttcatccctgatgcttctgtgggccccaagtggtaactttatgtgccttcacagatccagttgagggctcccctcaccagtgcccttgctgcttccccagcctccaccttgctgaagagcagacctgacctcgcagctgagcttcaaagcgctcagtgctcacggctcacaagctggcagtcctttgggaagtgagaagggaagggcttcctggctgtgcagttacacccggttaagtggacccctcggtggtactggggagcacggcgtagctcatgcctacgacactcgtggggcaggggcactgaggcagcaccaggaccagctggtgttcctgacccctcttgctcctcctgctcagccttatggttgagactggcttgtcaggcctacctccgtcctctctagaacactttctcacagagatttagccaaattctcttggcaccttggttgctttctctccatgccattcccagtcccctattcgttcccgcatagatctaatccccaactgggaatacatcttgcaattttttagaagattcctcatctaccatgtaaatcaccagatgaatagaaacaccataatggacagcagtttcttctaaagccaaagccaggtattcctggatttccgttccaggctggttgggactgtctcccctcacctcattcacactttttatggtgaaatctcctgtgaatggcatcataattggccctttacagtcaaacagaagaacagaaatcttttaagtaatctcccagataattgtcttttatttttccaatacctattatacctgggagtcactatatatttaaggtgatggagatttaaaatagggaatatgagaaagcttaatatccttttatgtcactgaagaaataacaaaagttaaatctctagttgatgaattatgaagtagctggttccttatgaaacaggattcataggatttaaaataaatttttgtagttggcagaacttttatttttatgtgtctcctagcatatgacttcagcaacacataaacccttctttccatttttcttaaaattctaagtagttcattcactttatcatgtctgtattgttcaatgttagccctatataagatggtaagtacagtctttatccattataaacttaaagtctatagccatagagtaatttatgaaaccagtcactcgtccagcatatatttattgagtgtttattatgtgccggatgctggagtgacaaaaaaatgaacaagatgtagatccggccttcaagtgtagctggtgattttccacaaaaccctctattattgtatcttaacatccaggagtcagccaggagttacactgatcataaatcgataacctcatttcaaagctcaaacacagagatggcaaataaagccctgggcagcactgactgaagcaacagatgactcattaatagcaggaggcaatgaataactttgccactgagagtgaaagaaaattccccctttgcacaatgcctttcacttaaatagcatttggatttcttaaaatccacaaagtttatattagagcgtcatccattaatgctttggctaggaggggtaagtgctgggaaatgtcatcttaagaacagtgggatttgtgggggcaattgtcttttacttgcagcggcataactgatcatctgttcaccatttacctcttattacttgcagtagttcttgaacaatgctgggagctaatatttcaatgttaaggactcggaagagacagcatagttgaggcagtgtagcaaagtggttaggggcacaactctggagccagccagccttggtttcaatgctggttctgtcatgtacttgtggtgtgatcttgggaaagttaccaaatgcctgagttcctcagtttgcttatctctaatatggaatgataatgacagtgtcatcttttacggttgttgttaagattcaatggtgataagttcttagtacagtgccggcccatagtaagtgctgtatgtgttgatcatattattatatatcacagctcttaaaatacagagattgtcttgaagacaattattcatcttctcactcttttttccccattagccactagctaacttggaagtgtgtagtaataaggccagatgactaaatggaaagcaaaagttatcttttaagcatgagcaaaattatgaacaatctatagagtgattaaagttgtgattcagtaataacaatttaaagaaatttatcaatagcaaatgtaaaaataatttaaatcaagaattagtttcaatcaagaaaatttcagattttattttattattcatttatatttgttatatctgtggatctgttttatttatgttcatgaggacctgtttggtctgaaagtaatttaagatagcttacaaagaagcatattatatatagtaaaatgatattaaatttaaattaataggaaaagttagataaatggaaaacaaaggtagaaaagaaggagatggtgttttgaatatgaaattgtatcttgaatcccccatgcttgctacaagtggtaatgagagtggtaatataattcaagaagatgattgtgtaaaacaaactggttgcttaggcagaggacatccattattgatactgtgataagagtaatttctgccatgttgctcagtttcagtattcaccagaatcttaagcattaaacttgaatattaaaccaggaacttggaatatggtctttaataaattcatgcagtaattgtttattgaaatagtttctgacccacagaaattattgtgttaggtgctacagagaagagagacatgtctcaaactatccctgctcttgaataatatgcattaaagaaagaatataagtaatacattaataaactacattcatcaggaggctgaagccagaggatcacgtgacgctagcagttcaagaccagcctgggcaatacagtgagaccctctctcaagcaacaacagaaattagctgggcatggtggtgcgcagctgcagtcctagcttcctgggaggctgaggcaggaggactgcttgagctcaggagtttgaggcttcagtgacctatatgatctgttactccagcctgggtgacagagagagacactatctttaaaaaaattaatagaggctgggtgcggtggcttgtgcctgtaatcctaacactttgggaggccaaggtgggcggatcacttgagatcgggagtttgagaccagcctggccaacatggtgaaactctgtcacttctaaacatacaaaaattagctgggcaaggtggcatacgcctgtaatcccagctacttgggaggctgaggcaggagaattggttcaatgtgggaggtggaggttgcagtgagccgagatcacgccacctcattccagcctgggcaacattgagcgagactccatctcaaaacaaacaaacaaacaaacaaacaaagttcaaagtagatagtgatgatgagaggtacacgtgtggtgttaaaagtagctccccatttatatcttaccgcattctgtggaccaccccacagaagatattgtaacaaataaaatctttatactttctaacatattaactcttttaatttcttaatggtggcttttaaatacttaatgattcttttatgtggatttcaaaagccagacagtgcagtatccatgcatagccacccaggactactaaaggtcatagtggagaagacttgtcataaatattataatcccatggataattctgtcctttaactctgtatgcaacttagatcataaacttgcaaagtggatgccaagcctcatattagttcttcatctcaatttgtcaaaaattgatttcaccaagttcagagagagagaaaataaagcacaaatgcactgttttcctagagggcatgtgcatattttctatacattcgttcaacattattaaacatttattatattatgggaatggtactgagcatggaattataacaaaagtaaattttttaaaattttcctcaaggaaaataatttattgtttaggtggagagacagatatataaacgaatagttatagcaatgagagaagtacagatagacatttgtaagaagggaaaaggcaagctctgcctagcaggatagagaaaaggccacattgaactggcgtttgaatttcctcttgaaagatgtgcattttgccaagtggagattgtacaataggaatgatattcatcctggttaggaaatgttcttggagcacctcccagcctttcggtctaatatttcctgagtacctctcaaggattcagtgtgggattaggtgatgtggtaattataaagaaatagaagccttgttactcgtcttcagaatgtttactcataaggggtagtaaatttccctccccacactttcaacagtgattaagaggtcatgactgtcagtcctaaattgtgtgtcacgtcataaattctgtagattagagagcatgatcatgtaattcacagcaaccagggcaagcctcacagatggggtaaggcctaatctgttccttggaaactgggatgaggtttggatgtgggagagagaatgctttaacagtcaagccacaaacctgtattgagggcctaccatgtgtcaggctcatgaataaagaagcagcatgggagtggggaaaaaactgggattgaggttacatgtgtttgtggaaaaacctggctggactagtgagtttgaggtgagggatggcgggcaataagtatagagtgaaacgagtttgggcaagaaaactgcagctagattaaaaggtgctctgaaggacaggcagtggcttttgggtttggcatttatgaaaatggggagtcaccaaaggtttttgagtatgggagagagctgctgaaagaagtacacaaataaaagtaaccttctttagggaagttacattggaacagctggaagggcttgtagagatccctttactcactaccccatctgaatatccttcagatggccatcatttgactgaaaaggcaatgaaggcccacagaggttataggatttgcttaagacaaatagagtaatcttgtctccatttcaggctccttcttttgatcttaacagtgtgtgtgttctaggctgggtggatggacagtaaagggagtaggagcatcgaggtccaggaccagccaggctgaatgagagggcaaacaggaagcagccgtgacccagattatgttacagccatagaatgagcatattagaactcgtagaagacctaaatgccatccagccttatcctattgctttgcagagagggacagttgagggcccagagggaaagtgactcacacaacagagcgatctaatgacctgactttaagtccagctattttccctgtgtccacctcccttcctccttcagattctatggttgtgtggatgggctctattttctgtccccagctagttacctgttcatgcactacaccccttggatcctctgttaaagagagacttagtaattgggatacctgcgctgccgatggatttgccacatctattctgttctcaggttgtatgttgtttgtgtgtgtgtgcttgtgtgtgtgcatgtgtgtgtgtgtgtgtgagagagatgtgctacaaaaagaaagctaagggaggcatgcagaagactgcaccagaatgagtttgtacctttatccaaaaaagccacagtttccttcattctttctcctccctagaaggagaccagttcttatagctgcagagaagggtagggaatgacagtaggaaaggggcattgctagagtcagaggcacaggtggcatgagaagtgcagaccagtcagaaacaaggcccatcacactcttaccctcagccctgtgctctgggatcctctctgtgatcctgatcgtgatcgtgtaagggtaagaagttgggaggaaggaacctcagcaacatctcctctcttgccctactgaactctggaagccacgttgttttccaggagaggtggaggaggtcagggcctagctaatatctggtgctgctggagaagatgctttccaaatggacagttaagaagagtgacgaaggtatttaagaaatttagccacaaaagcacttgtaaatagtgttaaaaggcagtgggaaagagatatttagatttggtaatttaaaaaagtcaatgcacacctatatgaataaagttttgagtagcctctcccctgcccctaagaattcggacatttatttaactgtggcccgaatagtgaatggagatgtacattttagccttcagggatcaacaaatgagtccttaaagaaacaacaggcctctaaataactaagggaagatcaatataaaattattcctgagtataaataataaaatatagttgaaaaattaaattaccttatcagaactttggttgttctagcaaatattttttgcacagtataaaattccagaatgcacacttaaggccgttcagctatttacatgctaatatacatttattattaatgtgcacattgaaatatttttttctcatttaaggtatatgtatatgtttataatagagtgaatatccctgaactccattcacacaacgtacagtattttttcattcatttaaactaagatttatctatatagtttatattttatatttggggaaagctaagtagcagaaattttataacatagacaatgatattcacatattcagatctacaactcagccctcactgctttacacatgtaattaggttgtttccatggtaatgatctaattatgggcttctccttggccttgtgtaatcacatttgctgcgttttggcagagatgttttccttattttgttgaactgcaacacttgacaagatgttctctcttaagatgaataatgatttttcttgggagacaaaaacaaaaaacgaaataacaccatcaaagttgatttgagagggattataggtatttgacaaatcatgccagtaataaaatatctattacccttgaaagcatactctatttttatctttgtgtgtgttattactgatggaaatcataggaggttctcattttaaaaaaccatgtgtgctatttaaatatatgattttcatggggcccagaggcttgaaggaaaagagatgttaggccagagaagagaaagctcctgagagctttgtagaaagagaactggagactgtattcagtgagaatattatattgcaattgacaaagctattcatgaaaagatatttggttatggttgccatggcagtaggaaacacctgaaaaaaatcaattaagacttatcttggcagggattcaaatgcaatcctttatgcacgtgcagaagaagacaggagatgtaaatacttgcagaaagacagctttatcatcacgtggtcccctcagaaaaaccctggaatatgagaaaaataaaagtttagctcttttatgtgcataaaatgacactgtgctataaagcattttttataggaaactcattcttacagtggaaaggatgcatataatgggtggtgcaggcttattgttttagggttagcaagaaggtgtgtgggctccaatgtcacagtgcccaaggtccagatacctggtattcaggggctgggaattcaaagcttgcttcttcaactattatggagacagcttcaaatccaaaattagtggaccagatgtctaagagtccagaatgttgaaactgctttctgagtatcattttgtgggaatagggtgggtggatatagtttttggtaacctaatttattaaagggcatagatatagcatgatgcttgggaataataatgttaataacctgattttcaatttatagcaaaccaacccctatgaaatattatacggcttggttttaggcttatatagtgttattttctcaggggggaaatgatattcataggatgtttagtaattataggcaattaacaagaaatttttaatttaatgtatttatttatttattgaaaaaatatttatttactacttatcacgtgtcaggcacagtacaagggcctgggaatagagcagtgaatcagaaagacatgattgctgctctcaagttttttatcattttatagagaaagtggcgaaaacaaacaaataaagaaacaaacaaacaaagaaaaaaggccaatttcaattctggcctaagcagtgttaagtagggaaatgtagggtccaaggagaacaaagaggagggtggtgtctgacagggtgacattcattctagcagagggaacagagaccaaagacaacatggaacatggacccaacatcacagatcaactccaaacaggacagtgtgatgggatcctgtggagtataagtgggaatgatgagaggtgagacaggcaggcaagcaagaccagagagttgaagtgctagtaaactacactgacaagcttggcccctcagcccaaccagaatccattcaaaggtctcaagcaagggagcaacatggcctgatttgcaatacctgctgctgttagctttagtggttttgaagcagtgattttggaaaaatcaatcgaatgattttcattctgaagtattttggctgctaactgggacttccattgtgtggtctaaggtgagttactttacctctctagtatcccgtgttttcctctacatgggcccttttagctttgtttctctatgatgcgatttctcagttgtgtttgttttttgttgatagacacacttgcttacagtgtgactacacatgcacccaggagtgaattatctttgattacttgaagttctgccctatccaccagctggctggtctaaaaccctttaaactcctttactctcaccatgaggtcttgcctcccagtaggattaagccaggagggcaaccgcgcctgtcagggagaaggatgtgggtttgcctgagtcactgtgtgtgagagtgaatgatggttttaggaagtagccataaagcattgggagaatggctgtgaatggctttcatattctctgctctgtttttgattacaccaaagacagcttgttattgagtagcttatagcatgtggctatgttttaagtacttgagtaacacagtcaaaataaaccagctcactctgtttggtgagcaagtctaacaaacatataaagaacataaatgtacttcttgtaagtcacaaatatatctagaagttaaaaggaagatcagaatatgttagttggtcttagaataaactttcccttaagggtttggtttataatgtgggcgtgaaattcagttttcttatgaacaattttacattatcgttaataatgaacaatttgttaagtattagcatcaacaatgtgatataaataacactgtgtgtttgatgttggtgtacaggtgattggtgtactgaagaaaggtaacgatgtatttattcagtgttgctatgtatctaatataaattaggtatttggcataatcagatgaaaaaactgttgcgcagaagttcattctataatgcacagttaattattgcatagtataataagtatggtataaaatatacttaatggaacacaggtaatggcatttagcctagctttgtaggttagggtaagaggtagttagcggtgggattgttacctgtttctccaatattcttaatcattcaagtctaattccagtctaactatgccatataaaaatcccaaagtaaccatgagaatttagacattaagggaaaatgaaatatttaaaagaatcccttgaatctggtcttgttgggtttctttctgtaaaaatgaagagaatgttctgactggtcacttagtcattcgttccttcactcaacatgttcaagtctctatgttccaggcactcttcctgggcctgtggttacagagataaacaagactgacaaggtcttggctgtcatggagcctaacttctaggggatcccatgacttaagaactctacctcctctcttacatgaaaaaacaatcttgtattaaaatcagacctctgttagatcttggaacagtaaaagtacatcagtggaagaaatggaatctgaataaattttgtagtttagtaaacagtattgtagcaatgttaatttctcagctttgataattgtatgatggttatgcaaaatgtcgacattaagggaagctgggtgaaggctctaagaaaatcctctgtactattttgcaactcttctgtatgtctaacatcgtctcaaaaaagaaaaaaaaatcctaacactaaacaaataaaaaaccttgggccttgattattttacttatgtatttacaatgtacaatatcagatcctgttaggaagtttaacaaaaaataaccctgtgggcagcagtgtacgtgagtgccaagaaatgttggctgaactagattattcactgaagattaatcaaaatattcccgtcttccacaattaattttgaagattctacatgtttggattgccaccaaaacaaaaagtgccaaaatagcactgtcgtacacagctttgttacctaagagactgaaatgtagctcaagtgtccagcttgtttctttaatgtgcattaggcgaggcccacatatccacagaagtcatataaatgagccacttacaaggcttaccaattcttgctcaataccacaaagactgtgtgtcaaagagaatggttgtaaattaaagctgacacacggcagctgtgaccgtagtcagtgtcaaatcccagtttgttttcttgtctttcagataagctcagtgagttgatcaataaatccagataattactactattagaaatgttaaaagtgttttcttctttcttggcctgtataatttcctctggggtatcatgactgctggtccagtctcaccggggtacatatttcattcaacccagtgactaccacctaaggcactgtggctcagcccaacacccttttccttgagttcaccttcttgcccatcaaatgcctcttgaactggcctggggccttggctgtggcagcctgtttgcactgcagagcgtggtctcagactttggattgctctaagaattgtcattctcttcaggggctgaaatcctcacattttaacatcattatgtatattttgtcttggatcaaattgattaatgaatgatagattaccccaaatctcgctctggtgtggagctttccatctgtcttatttttttcagtgaacatctttccaaatttcagcctcttctccacccaccccccaccgtagcgccctgcctcctctccatttgcctcctcttacctttctgctgtatctttttccttattctccttttttgttctccaccaagtatcttcagagaacctcactgtgcctggagcagagttaggtcctggggacacaaagatgaatgggacgcactctctgcttatcaggtgtgtacctcttggctgtcaccctctcctggccatgctctccctgtccctgcctgatggggggtgggcctgactcctccttggcatcttcccctctctctccatacactgtaaacctccgtttacaccagacagtctctaaggtaacacactgatgaggaataactgtcaaacagcatgaagatatttaatgatggcttaaaaagagcctgggaataaagtcatatgagaaattggttacatatttaatttaggaaagattgttacagtatcaggggagaaaaggaagaaaatacattgcttcccataaaaatgcagtaaaagataaagcacaaacagcccctctgtatgttgaaatattgtcattctgtgattaaagggaagcaaggtgttttctgttcagcacttgtgccagggaggcgtgggggagggataaaggcatccgggctacaagtttgaatttctagagctctgaggaaattaaaatgcaaacaaagaatagtgagattctgaggcttttcagaggaggagtccagtacttggtgagccagatgggccatgaaatgaacttaaatttcaggccatttgacacctctcgattttcctcagcttgacagcactaataggaaacaaggtcacatcattttttttttcaatgtacaaaaacttatattatgtgttttctaccccgagaatctaagaaaagaaccatcttgcaaatgagtcagcctggagtatccagatagctcagtcaatttttggctctgtgctttagcacatttccttaatggggtggattgcgcttgtgtgtaaggcatcaaaaagtggcaggcatttcctagtccatcactcatttgagctactgaacctggaatcaataaatattccattactgcattatttatggccaactataaacaatttctatcattaaatctttgccttttagttgttcctcattagcaagggatcaatttcagatcccagtctaggtcgtgcccagaattaaagaagagcaatgtgtgagaatgtttattcatatacatatttatattttatattaaaatagatgcatgatgaaaattatttctgcatctaatattttcatagtgtttcagttccaaaagtcaccttgaacttcagttcggatgtggtggtggcttgggaaaagcactggacagcatttagacgagtttgggttcttacatctccaaatctccagtaaccagctgtgtgctttcaagtgaatcatttgccccagtttcttcatctgtaaaacgagtggattagaatggatgatgcctaagtttttctttaggtcgtaaattcagtgaatggaagaggattgtagaaaggagcagtagatgacatgtgggaacagggtcatttgcaaatgtgcagaattcgtattacgggagtgataatgctggtcattgtcttgagtctgagtgccctctgggagatctgcattcagtgattaactgttttcttgtatgaggagtcattctgtctgggaggacatcagtctaaccagagacgggagactgtctgtgagctggagatattgaggacatgtttttttgttttgctttttgtgagaatttgaatgctttggatgggcttgcactatagtttactacagttcccaccacttggcctcctttactcctgacctctccgccccagaggtatttgaattggtaacacctagtccaagtaactcggaaggcagagctgggcagtcactcaggcagcagttactgagcacctaccatgtgccaggcacagtgggtggcactcgggataccaagggagacatgttgggtgcaacttctccccagcagagcatacacgctagcgaggaacatggaacacatgtctttttacaaacacttagataattacaagtgtgctaagagctgcaaaggagcgtgtagtgtgctgtgcctgggtataacaggagcatctaattgagtctaggagtaagggaagacttccccaagaaaggagtttttaagctgagacataaaatataagacaagactattcaatagagactatcagagaaaatgttgggagagagaggcagaacaagttcgaaaataaagaggtgatgtcttgagcaagattaacatggattagcaaacacatctctgtgcttgtttcttcgaaattcatcaataaaagactatgaagaaaacaaaaaagggattcctcatcctttcttctgaaactcgctccctgcccatttaggtcggtgactgattcatagattctcccttacctgtctggcagcctaggagttgtccttgcctcttctttgccatctcactgcacagctctctggtctccaaatcagtctcacttctactttccttacgttttacttgctccccttcttgtttcaaagccctcacacctgtacaattgatctttcccactggagtctgagctactgtctttgcccataagggtccccattccttatctagtttaggacacatcttcctaaaatacatccttacactgcctgaccttttcaagagctgcctctggtctcctgtcatctaaagcacaaatgctcaatctcttaatcttctgccgagagcactgaagcacatgagaacttacgcacctgagttcttcagtccggccactctggagtatgcagatgatgtagtatcgtgagtgagcattttggaagagaaaaacagtgtagctacaacagacgtttggaagaattacatgattctttaaccccagtactctagtacactagtgattttctttcctatactgtatattctttttgttcatgtgcacatatatgtaacagattttaattgcaatataatagacccttgaatcctgcttattataccttgtggtagatggtgtttctcaagatagtcgcaacaagatttcccattcatcatgcccttcctccaatatgacattgaccctcctattcagaggaagggatgatgttctctcctctcgaatctgaatgggtctgtgactacagccaaagtgatgcgacgtgacttctgattctaggtcataaaaagtgatctggctctgcctggctttcctgaggtgcttgattttggaactgaggcaccatgtcatgaggaagcaggaagcacacatggaaagtcctgtgtaggtgttctgggcaagaactccaactgagagctcagtctgcagctggcatcaaccactagacttgccaacatggaagctttgagatgacttcagcactagctactagccgtctgaaaccacccagagacagggctgcccagttgagcccagtcaacacctagaactgtgaggaataatgaaaaagcaattgttgttttaagccacgtagtttttggatgacttattattacagcaatagataaccagatacatacctcaaaccagtaaaatatagacataattgtacattagaaatgtacgctgagaaaaaatctcaaaaggcaaaagaaaggctttattacaaatataccaacattactcgtaacctggaaataatgaggacagaaactcagatgtccaatttttgtttagtttttataactaggcacatttgctttaccatctagcttgtcaactccttgaacacatggactgtgttttaaacttgacataagtaggttcctctctactgtatatttttttaacaaaataatgtattctataaatttgttgatgattcattttaataatttttcaaaggatatttgaattattttatttaatcctttcaaagccttgtctgattttacgggtgaagttaagagccttctaaggtcatacaggttgcaggggtagcactgtgtcttgtatgtacttagatctgacttcaattctgggacatcttttacgacaccacgagggctgtttgtcctgcaatttctttctaagaatatctgtagaaacatgatggatattcatgcatctcgagaggactatgtctttgttctgtagctttgatgtgctttcaaatggctttactgtagctttatagaaaccaatagctcagaacaggactcaagatggaaaaagtgcccattgttcttgctgagggctgcatttccggctcagtcataatatgtaagaagggctgtatcctacagataccctaaggatgaaatacaaacatcatcagttactctggtatctttaataactgatctttgcaaaaattgagaataagggaaggataaggcaaaaagcacattcaatgcggagtcagacaggtctagatttgaagcatgattgccgcatgccatttctatggcttcaaaccacagggcctcccagggcctcagcttcctcacctcttaaatgggaaacacggtagttttcatctcattgggttgacaggagacaaagagatggtgtatatgaaatactctctaaaatgcctagttcttaatccaaatggagaattagtagcttattatatataacagcaaaacaatcatttttgttaaactttttaaaaatataagaacttaaatatcacctgcaactatctagagattcttattccaagtttttgtgtgactttgggtaaatcacttcacaactctgggcctcaggaaagatttggctagaggatttccaagattcctatcctctgaatttaaaattctgacttttaaacagttagttatatgacattatgccatttggggtttgttaatcttctaattggtttcattgtaattaccattgagccatcatagtttgtctttcaaataccaagtgaccttctgccattccggtacttgatttgctgacagttgtaaaatgtttaccctctgcaaacattcattagtaatggtcacaatttttacagtgtcactgcatttttgcaaagaatctgatagctcctttatcattgtggtacatcattcaattggagagtgaatttgagaaagtgtcaaagccattcttaagggtatgttgactttctgctggtgatatgtagaactgtttgcctgttttcttatttttttcagtctgaattaaataaaattaaaatcacaactgtcatttgtgattcacagaggaaatctgtgatttgcaaagggttacaacatagtactataaatttgatattatccacatttacagaagggaaactaagcctcagttcgtgacttgtcacacaaatgcagtcacgtgtcacttaacgatgggcatatgttctaagaaatgcatcattcggtgattttgtcagtgtacttacacaaacctagatggtataacctactacatacttaagctaaatggtatagcctattgttcctgggctacaaatctgtatggcatgtaactgtagtgaatactgtaggcaattttaacagaatgataatttgttcatctaaacatatcaaagcatagaaagggtaaagtaaaaatacagtattataatcttacgggactatcattttacatgcaatttgtcatggaccgaaacattatgtgacacataactgtaaggaacaagtaatttcagagctgagtctctaagccttgtattggttcttgaaattgctcatctaactacaccatgtgtttctctgttggagagagattcactgtcattgatacactcttggttgaagaaaacattgctaagcaatctctaaatatttctgttgaatataaattaaaatttcagaaaaataaaaatggggatacaatggagctgggagaaaatcagggaaaaaatagtctttaaaaatgacacctttccacaattaggaaaaagaaatagattgacgtagcacttgtcaaaattatggtgaggcaatctcagagattgcacaacagcggcaagaccagggccattaagaggaggtggtgggagtgtggtgcctttgtattgtcttccaaccttgcaagccccactctctagctatttcctgtccagtcacttctgagctagatccctaccaccccagccacacctcttgtttaaatatctggaaaactagaatttttttgttattatggtatggtaaatcagaacaatgtagtgagtacgctatagtgagtgtaactgagtgatacagggaaaattggcatggtcagggaggcaggagacctctcaaagctctagtttcctttcattcatctctaatgttctatgactgtaacagtaaaacagttcctagtgattaaagttagaatggaagtcagtccatgaattgaatgtaagtcccggccatgctgctgaacatacttaatgtgcaacatcacatctaggctttgttgaccccatttactttgccaggaattagaaattagagcaactcatctcatatgcgatgatacttacataaatcaaatacaaataatgaatatcctgccctctcatatgttccttctcagggaagagctttggagtgcaacatggacttgagagttcagaaaggtatgatcagagggagagggagttgattgaaaaatgtgagtagaatgaacaatgaggaaagaagagtagcatgaaagagaggtttgttgagtatttaacatgtgtaagtgttttacacacatcatttctagttttttttagtagctctgaaaggaagataattttatcttcattttacagatatgaaagcagaagttcaaacagattaagaaacttgcttaaaaaccctagaaagtaatcaggagattaatattcttttatttttagcttctttttccatcagaagctaaaaatagttgatagtgtcacttggcctgagagtagggcaggtagtcatctattccccttgaccctctagcagatcttagtagagacagagaaaatattatgaaactaagaatttttaagggattggaaaatctgaggatggggaacagacttttggtttttgggggtctttggcctcttggcattttgatcacagactgttgaattggaagctttgagacttcttggagtgtgagctacttgaacacctttgaactaggtggctatgtctttggagctagagaagtttctgggaaggcagtcatgcttggttctgtgagcagacaggtccaaaggcaaggcagattgaaacatctgtttaagggtactctctgctcaaggaaaagagggaaggtgttgctcagtttaccagataggaaatcccagacacaggacagatgcttttctcaaaaatagagcatttgcattacatggtcccacttttttactgtgcctataaaaactgagatgtgacatggactgcataaaatgaggaatcctagctatggctacattaaaaaaaatatgcacagaaggatatccaattatacagattcaggctatactggctcatgtacactctctatggtataatcaacataacatagctattatatgcccagccataagttgaaataatttaatacccatttgtcagatctatgacacatattttaaaatgtggaatgtttacctattataaaactgatcataagaaaatcagaagacaagccacagactgggagaaaatatttgcaaaagacatatctaaaaaaggactgctatctgaaatatacaaaaaactcttaaaattcagtaagaaatgaacaactcaacttaaaaattggcaaaagacctgaatagacacctcaccaaagcagatgtatagatggcaaataagcataggaaaagatgcttaaaattgtatgtcataggaaattgcaaagtaaaacaatgagctactatacccctattaaattggtgaaaatccagaacactggcaaaaccaaatgtagtgaatatacagaacaacaggaactttcattcattgctgtcatgaatgtgaaatggtacagccactttagaagacagtttggtagtttcttacgaaactaataatactctgatcatacaatacagcaactgtacccaaataagttgaaaatgtatgtctacacacaaaaacctgcacacaaatgtttatagcagctttattcataattacccaaacttgggagcaaccaaaatgcccattagtaggtgagtggataagtaagctgtggtacatcttgacaatggaatattattaagtactaaacagaatgcattatcaagccgtgaaaagacacgaaggaaccttagatgaatattactaagtgaaaaaagtcaatctgaaaagactacaggctgtatgaatccaattatatggcattttggaaaagtcaaaactatggagagttaaaaaaaatcagctgtcagagattagtggggagggaaggatgaataaggacagagaatttttagagcggtgaaactattctgtatgatactctaatgatggatacatgtcattatacatttgtcctaacccatagaatgtacactgagaatgacccctaatgtaaacgatggactttgagtgataactgatgtatcaatgtggcttcatcccttgtaacaaatgcaccactctggtggggggatgttggtagtgggagaggcggctgtgagtgtgcaggggaaaggagtgcatcccatttaattttgctgtgaccttaaaactgctctaaacataacatattttaaaaatgcacaaaagaagaaacaaatcaccccaaatttcaccatacagtgataattaccacttactttagtatacatctttatcattcattccacaattattcatgaaacacctactatatattgcgggttgttctaggcactggggatatagcagcgactcaaacacagaaaaatccttactctgtggagcttatgttgacctctctcaaatagagggagggctcagaaaataagcaaattatacagtatagatgttagtaaatgctacgaaagattgcaagcaaggggaatagggagaatatgtaggaaaggggattctagtttaaatagagcatttagagaattctctatttttgacatttaaggcaagacttgaaggaggtgagaaaatgagctatgaagatatttgagggtaaggtattttgggcaaaaggaagagcaagtgaggaccctgaggtttaagaaacaaggaggcaagtatagctggagtgtattaagcaaccaagagatggtggaaggtgttcataatgataagggtcagccagatcaagtaggacattatatcccatggggataatttggcttttattaataactggagtgagacaggaagtcattgaatgactttgagcagaagagtgatgtgttctaacttatgttttaatatggtgactctggttgctatttagagaatgctcaacaaggaagaggttaaaagatggagattaggctattttaacaacctagatgagcaatattgttggcttgaaccacagtggtatcaatggaggtaaagagaagtggttacactctgggcatgttgtgaaaaaagggctgacaggatttttcagtggatacgtaggatataaacactagtgttgagtcaaggataactctaaggttttctggcttgagtatcttgaaatatagagctggcattaattgagatgagacagactttagaagaaacagctttcacggggaccaagaactcgggagttaggattggggcatgttaagtttgagacattttctatccaagtggagatttggatagatggatttagaagatagaaagaagtctagtctagaaatatttatttgggaactgtgtagagtaaatatgttgtttaaagccttgaggctggttgggatcacccaggacactggtattgaggggatattgaagtactgattcttgaattctacaaaagaaataaagcagagatgtgaaaggaatttcttcaactatacacattttgacataatcatcttctaacatggtgtttaatttgctctgcttcacttagcaatgatataatgaatatttcccattttattatatattctacaatatcactttgaatgactctcttaagagtgtattataacacatgaacctagccccctattgtcaagtcttttgagttgcttataattttctcatattacaacattttcagtgaatattcctatacatgcatgctagaatacagaagtagaattgcaggatcttttgttgcatttttcaaatttctctccagaaaatttataataagaagttatacaagaaaatcctatttatttacaccttccccaaacaaggtgctaataatatttgtaatctccaatctgttagatgaaaatgattgaatataaaatttcattttttcactttagtgttttcctgattggtaatacagttgaacgtctttttgtttgtttgtttgtgtgtttattggtaatttggagaacatgatttcttttgcttgttacttatggtcagttataggttaagatgaccacagagtactttctacccacctcttctctcagtccagctcaggttggggttggttgtccttagtgtaagtattaggatctgattcaaagacgatcttcacctttgtatctccagtgaatatggttggttttggccttagggagggctctttttgtaagtttgctgtttattaactccacacgtaaacagtgtactaaatagtaagaggaatcctctgctaatgttctgcctcaaacctaagttcataagttcaagaatacaagatctttaagtcagacccagtcaaagattagtcagcacaaacatattgtaattcttatatttattttttccctcatttaagaaattgttaactgctcgagttcattccagaaaaagttaactccagtatttttacatattgaaaagacaaatcatatttggaacttggcatatagtttcaactatttttattttattttttgcctaaatgtttcaggccttggcaaaatggaaagcaatctgtgccaagcctctctctacctttattttctaacccatgtgtatttttttaaaaattctatctgcctgatttttattcccttactcttaaattgtcacatggagtttattaagacatcctggatgttcaaaagaatttgaggctttccccttttgatagaaccaggatatctggatatctcgttttgttggctgtaaatacaacttgaaccttaagaggataaaattcaatctgaaaatttcaaaatatttcaaaatcatgaactaagagaataaccattttggtgttttctttttctggttatttttatatatttgattcttagttgttatttaaaaaaaagaaagtaaagttttatagaaaacatatggatcaattataccccaagtcataaagactaactcagaattaaaaatatgagtcttctgatttttcaagaggcttctgagaaaactgaagtgagattatattaatagcattttcaagaggcctattccaagatgctaactgactctagtatatactgactctcttggaatgatctagcttttgtgatgtgttcacaagtaggccaatgaataagcaatttttcataaattttattgcctcaagccattagtaagcctaaggcacatttggaatcataatagttttttaaattttaatttaattatgatgattacttgactataatattgctatttctctataattttatgcttgaagagtcaatctttcagtgagaattcttcatttatttaccaaaaggaaaaaaagaaaattatcaaaaaagataatcattctaccacagcaatagtataaagcaaaaaccaggaccagatggtgagagtggagggactttcgtcatcttctgaactccatgctgtacgcatcattcagtttttcatctttgctcttattttctttaatttgcaaaaagataactctatggaaatggtagttttaagtaacatttaaacattggcttttgtttactttttctgtttgaaaatggcagcctaaacacaatttgtggtctgcctcttaagtccacatatttagaaataatagagaaaatttttgtttgttcatgtcttttactgattaaatatatagttcatgttcagaacaactcttggtatattacaaaatgggaaaattcttaggagaagggagacatcataatcctgggaggaaagtgctgaacaaagcggatgcaggacaagggtgcttcatgtagtttgtgaaagcaaaaggcaagaggtaatccagggacaacaatgagattgtctatctctaggtggggcaaggagcatgggactttcgggaacagaggcaaggtggtgctcttagtagctagctgatgataacctggaaaggaaaggaactctcattctcagaagaccaagctatagcatacatagcccagtggcacgtgggcctttcccctgtccctatagatacacacccaaagcactgggctatgcaagttttcagtgacttgaacccctccctgtagacaatgtgggcaaacagatgcagaagataattgaaaagagtcatcaaccacaaaatatagtaaatctaattaatatttagagaaatgtaaaggataatgcaataatgtaaaaccagaatagacagttataaaaagaactagaaatcttggaaataaaactataattgctgaaagtaatttgcagctgggctagaagaaatacatgctcattgtagaaagctgagaaattgctgaaagttattaaaaagttagaaatatcaccctaaatctaccatttagagattactgctattaatatttgcatatattttattatagtcatttttttcacatttttatataattcttgacatatactaaatatcgtacttctacttgctaaccctcctcccctcctggacaatttaggaaaaaaggcaacttaagttgctgctaggtgcctttttcactaatgtattttttccattgactttttatcatagatcattttattataatgtcttaatttaataaagatcccaaacacagggcttgtgcttagctctttaacattctgctggctgctgtgttgtcttcttttcacattaagcttggtaaagatgtgagcacacacttcgtctttaagtgtagagtgttagtttcatgcttaatatttatgactcttataattactcttataagagatccactattactagaaacttcagctctcaggttaataatcctgcattttaatgagctctaggtaattatactttgaagtccaagacttcttttcaaaaattgtaaattgagtttcttttttttataactatgtaattttaatttcatgttgaagcgcaatgaaaatttgcacattatagtacaactgtaattttagagggaaaaatcagtaatagactaggtaattttaattcaggtcacttctacaaaggatatactgagaaaagtcaaaatacgctgagaaaaattttcttcagaggctacagaattaatctattagtcaccttgacaatacagcatacgaataggaaaacgtatggaatgagctggttttctgctttatgaaaatggttttgttaaagccaagtttcataagtgtcaaatggaaagtagatatttcaattgctagctttcctccaaccaggtaacgcagccaaattgacatgaccagaatcataggaactttgagtcttaaagtaggcacattctgctccctttcctccattaagctgattccctgctgccagctgaccttgcttatgacaggtgtctctacttgtactttactgaatctcaaggcttagtggcaggtaaagtttctagttatgtaaaatcatgttaatgctcccaggcaaatttaagcttttatcttggcttattttgacggcaaggcagttgaatgcctccatgcttccctccccaaatgtccaagcacctggccttggaatgagtggagtactggaatgaagaggccttggaacaaactcaatatacctaggatgatactaccctgtagtgttgcgtcctatcagataggagattataaataactcaaagcaggaactcaggcttagagatcttccatccgcttagctcctgccacaatatcttacaaataatatagtggataagagcaagcttgtgaaggcaagttccgactgttagattcgtgtctgtaaaacttgattgtgtgaccttagataatttaacttctccaagtctgagttttatctctataaaatgggatcaataataacaccttccctacatggttttgattaaataaataatgtaatctgtgtaaagtgcttagcatcgtagttctaagtgtttgacagagatttgttctcaagtaattgtagtactgactctgcttagaagtacttgatgtgttgaaaatttatctttcttcaaaaattttatgctcctcaaggttgaacagttatcgtttagttaaatagcattgacagcatattttccatattagcaagattagttggcacataggaaagattgggggaagtgcatttttaactagccaggcaactgaaggcattctcactgatacctacaatgcaggattggatgaagatcagtttcatagtaaatagaccttgctttttctatatgaagcagcttatctccctagactgtctgccaaataaacattactttgtgaggtcaaattctaaaagacataacatattttgttatcttcctctagaaacatgtgcctcatttccttgagcaaccttgctatcagttcacagattatatacctttttgaaagtttttctggcaagaagagatttattttatggagaaattagctagagcaaaaaattctacttaggcagtactgaatatatacattccccttttgtttaaaattaacctcttgtccctactcgttatatttatgaggactactacaagatgaccatagctttgcgacttttttaaacaactaaagctaaacacaataaagaaaaccataaaaagcaaagtttactctgtctcctgctctctctgtgatgtgtttgtagtatgaatcacactggataaccttgtcacacttttatttgaaatggtagcctcttgaatgaacactctttacaggaatattatttaggttttaattaataatgaaaaattcactaattcatggtatcttatttctaattgtttatatattaattaggtcatttaaaaaaacctttattttcctaggatgcaagggaaagcacaaacttgcaggtttatgcaaactttaattaggcatatagaaaaacacattagcgttgtagaaagggaaatgtacttaagaaaaaacataactttttaaaaaacttttttagcttttaaaaaattgtatgtttgtttcacaacacacacggaggcctgttgcggggttgggggagggggaggaaaagcattaggagaaatacctaatgtggatgacgggttgatgggtgcagcaaaccaccatggcacatgtatacctatgtaacaaacctgcacggtctgcacatgtatcccggaacttaaagtataataaaaaaaataaaaataactgtatgtttgtttcttaaatacattttcctttctaaaatgcgaatgttgacccattaagcaatgtcaagagaaagtcaaaaaacttaaaccactagacaattgggtctgtgtcacgaggaaactggagtgtcaagcaagtaactctgagcaaaatccgtgcttcacatgagattatgccacaacctccacttttctaccagtttccattactgaggcagggagacagtgtccatgcaatttaatgaccaagtataggaagaagaatggctctttccacattggatttttctctataagtgagagggtccacaatggccttgataagaaacagctcttcattgagactttgctgctctaggtgggatgcagataggaggctgatggaggcaggacctggagacatatgcaagtaacagatatccttaaaagattatggatttcttggaagtcaagttctcatgcattttgatcatcatgtgtattaaactttgaacaagtccactataccactttgtctagccatcattataatcattataataggcaacatactgaacacttgtgatatatcagagactgttgtataacccacctagttcttacaaacgtcacatgtaggtaatcattattatcacctttgtagaagaggaaactgaggcctagaaagtttaagtcataggtccaaggtcatggaactagtaaatgggggactgcatttcaaggaaatctgaatcttaagttagagtaaagatgaaagcccataataataataataaaaaatcacagtagctactattattgctttacgatactatcttatataatcatcgtaaactcactaagaggtgttaatctcactgaattatggagataaataaacagggtaataaagaataaataattttcccaaagtcctctagctggaaaatgagagagccacttatgtttgtccaattctaaagctctttgttatacatagagtcttagaaaattacttttgctgtctctatgtatgcttggggactaggttttgtcttcttcaagtatttgaacttctgagttcaactctttaatttagtgaagcaatttgccgctgggtattcttagacaagttactcaaacctcagtcttttcatctgtgaagtggaaataataataacagaacctacctcatcaaatgaaatcattcttgtagaggtcacagttgctgatacacggaagtgctcagtctatgttagctgactttggtattattaagaaaattagacaccaagtagtatggtgctaaaggagtcaaattataaatgttctatagaaaaactaaagctgtcccgtaaatctttaaagaaatttcaaaaattcaaaaccaaacaaatagttttctttaaaattagctttcctatgaagaaaacaattctgtacagctgaagaatgggaattctcttcaaaagttaagagttgagaagggaaggcaagtctgaccctgactgcggcagagagattgttcaaacaattgttctaaatagattatgatccttgtggatgaggaggtcatgagctgaaaggaagactttgtagataaagttttagctaaattagaagaggcaagctatctcctgtgatcttagaaagggaatttcagtaactcaagactttttgatacttaagtaagcttgaagaaattatttacattactatggaaagcaactagacatgaatagagaaaaacagacaaaattcaccttttctttttcttttgacttctttaatcatttgtttaaataagactgggaaagacttcagtatgcgtgagactataaacacagaaaaggaagattctgtgagagtgtatataattatgcagtcgccagtaaatttgaaaaaaaaatctgttgctaaaatgttaaaataaactgcattctgaaaagtcttgatgtatctcacccaagctattcaactttgtctccacacagtcttgcctttagtttggctcttgcatacttcccacgacattctattctctttaccaagaatgtgttctgctcttggaacctgttcaccaacccaaagttcatcagtctttctaagtcagctcaattctcaattgatctaaaaatgtgtgctttaattactttaagcattttggtgagtagaaaaaaatgtagactcttaaataagacttgtctttgttcaaatcatggctaggtcatttttatttaactgacttgacttcaacctctctggtctcagttttctcatctttggaatatagtgctttatagaaatttgtcattgtgaaacataataatggtaactatttttattcttggtcttttgttgctttatgctcttattacatcttattttataactatatagtttggacttaggtttgcaattctggccatgatagaataagatgtatcagacttacccttcaaatattacaaaactagaaaaactacatgcaacgtgtgttttcagtctttgcacaatgtatagcatagtactgggatcactgacagaaggaaaacacatgaggtaagctccatattcattcaggctttctgcatggaagtccttacaaaactgcagtctctgattgtggagcccaaagagagaacagtggtcttatgagatatagaaaataaaaattgtagatggggactggtgaagcagctggaatttgtggatcagggcagtgaagaagagggaatgtttagagaaagagctccagaaatctgcactggagctgtcttgagtctctggctgaatactaagatgtgtacatataaggcaagattccatgaggtctggtggagaatgactactgggatgtgtaagctgagcagtgtaattctaaatatttcactgtgctaaaagactcgagtgaaaggccacaacttagaaatagtaaggattggctggatgcggtggctcacacctgtaatcccagcactttgggaggctgaggcaggtggatctcttgaggtcaggagttcaagaccagcctggccaacatggcgaaagcctgtctctactaaaaaatacaaaaaattacccgggtgtggtggtgggcacctgtaatcccagtggctttggaggctgaggcaggagaatcgcttgatcccaggaggcagaggttgcagtgagccgagatcgcaccactgcactccagccggggcaacagagagagactccatctcaatataataataataacaacaataataaagaaatagtaatagtaaggatgtaaggattcctctggacccaacctaccaaaatctataattaagcctaagtgggaccaaaataatccacgagtaaattaattggctagtaatgcaaaacttaagactttctaaagataaaataaaaatctagaatctcaacaacatttctagaagaagcaggaaaatgtgacatataacctggagaaaactaatcaatggaaataaatgtaaagatattacaaatattgacactgacaactattcaaaatagctatgttaaatttatttaagaatttagaagaaactacaaaacactgctgaaagaaatcatagatgacacaaacaaatgaaacacaacccttgctcatgaatggatacaatcaatattgtgaaaatgaccataccgacttgatcattgtggataacctttttgatgtgttgctggattccttttgccagcattttattgaggatttttgcattgttgttcatcagggatattgtcctgaagttttctttttttgttgtgtctcttcccagctttcgtatcaggatgacgctggcttcataaaatgagttagggacgagtccctcctttcaattgtttggaatagtttcagaaggaatggtattagcttctctttgtatttctggtagaattcagctgtgaatctgtctggtcctaggatttttttgattggtaggctattaattactgcccctatttcagagcttgttttggtctattcagggattcgacttcttcctggtttagtcttggtagggtgtatgcatccatgaaggtatccatttcttctagattttctagtttatttgtgtagaggtgtttatagtattctctgatggtagtttgtatttctgtggggtcagtgatgatatcccctttatcattttttattgtgcctatttgattcttctctctcttcttctttattaatctagctaatggtctatttggttgatttttttcaaaaaaccagctcctggattcattgattttttggagggtatttcatgtctctgtcttcttcaattcttctctgatcttagttatttcttgtcttctgctagcttttggattagtttgctcttgcctctctagctcttttaattgtgatgttagggtgtctatttgagatatttctagctttctgatgtgggcatttagtgctgtaaatttgcctcttaacactgctttagctgggtcccagagatcctggtacattgtctctttgttctcattagtttcaaggaagttcttgatttctcccttaatttcattttttgcccaggaatcattcaggagcagatcattcaatttccatgaaattgtgtggttttgagtgagtttcttaatcctgatttctaatttgattgcactgtggtctgagagactgtcatgatttcagttcttttgcttttgataaggagtgttttacttccaactatgcggtcaattttagaataagtgccatgtggcactgagaagaatgtatattctgttgatttggggtggagagttctgtagacatctacaaggtccacttgatccagagctgatttcaagtcctgaatatccttgttaattttctgatagtggggcattaaaatatcccactattattgtgtgggagtctaagtctctttgtaggtctctaagaacttgtttcatgagtctaggtgctcctgtattgggcacgtatatatttagaatagttagctcttgttgaattgttccctttaccattatgtaattatcttctttgtattttttttatctttattggtttaaagtctgttttgtcagagactaggattgcaacccctgcttttttttgctttccatttgcttggtaaattttcctctatccctttattttgagcctgagtgtgtctttgcatgtaaggtgggtctcctgaatacagcacactgatgggtcttgacttcttatccaatttgccagtctgtgtcttttaactggggcatttagcccatttacatttaagattaatattgttatgtgtgaatttgatcctgtcatcatgatgttagctggttattttgcacattagttgatgcagtttcttcagagtgtcactggtctttatattttggtgtgtttttgcagtggctgttaccagttttttcctttccatatttaatgcatcttccaggagctcttgcagggcaggccaggtggtaatgaaatccctcagcatttgcttgtctggaagtgattttatttctcctttgcttatgcagcttagttgggctggatatgaaattctggattaaaaattattttatttaagaatgttgaatattggcccccaatctcttctggcttgtagggtttctgctgagagatctgccgttagtctgatgggcttccctttgtaggtgacctggcctttctctctggctgcctttaatagtttttccttcattttgatcttggagaatctgatgattatgtgtcttgtggttgatcttcttatggagtatcttaatggtgttctctgtatttcctgaatttgaatgttgtcctgtcttgctagttggggaagttctcctggataatagcctgaagtgtgttttccagtttgtttccattctccctgtctccttctggtattccaatctaccttaggttctgtctttttatgaagtcccatatttcttggaggctttgttcattccctttcattcttttttcctattcttgtctgcatgtcttatttcaggaaggtgggcttcagatgctgatatcctttcatctgcttggttgatttggctattgatgattgtgtatacatcacaaagttctcacaccatatttcagctccatcaggtgatttatgttcctctctaaactggttattctagttagcaactcttctaaccttttatcaaggttctcagcttctttgcaatagactagaacatgctcctttagctcagcataggtttttattacccatcttctgaagcctacttctgtcatttcattcatctgatcctccatccagttctgtgcctttgatggagagacgttgttatgatttggaggagatggtcttttgggtttttagtattttttcatggattctttttcatcttcgtgagtttgtctagttttggtctttgaggctgctgacccttggatggggtttttgcaggggtcttttttgtgttgctgttgttgttgatgctgttgttgtcactttctgcttgttcagtttctttcaatagtcaggtccctcttctgtagggctgctgcattttgctggggtttcacttcaggcacttttcatttgattcactcctgtgcctggagatgtcattcaaggaggctggagaacagcaaagatgggttcctgctccttcttctgggatctttggccttgaggggtaccaacctgatgccagaggaattgctcctgtctagggtgtctgacaacccctgttagagggtctcactcagctgggtggcatggggagcaggacctgtttaacaaagcactttgtcccttggtggagagggtgtgttttgctggagggaaacccactcgttgggccacctggattcctcagaactaccaagaggagaggctaagtcagctggtctgcagagactttggccacccctccccctaggggctcaggcccagggagatccgaattctgtctctgagcctctggctggagttattggagttcctgcagggaagttccacccaatgaggagggatgggtcagggttaagcctgaagaggcactctggctgctgattgccaatagtgggtgtgttcagctgtggggacaagccttgggaccaaattgtctagcctccctggctccagcaagggaaaagcgcagcctggagctatagaaatgggtgccgcccttgcctcgccctggagcttagtgtgttaagcagttgggattcccagtgctggctgctgcccctccgccaaggagctcaaatggcttagcaggcagctgcagctggtgctggtcgcccctcccaccgggaattggtaggcttaagtagattccagctgagagtctttaagaatctgtgcattctggggttgggacgctaggcccaggtggcgtgggtctgcaagtgggatcttcccacccttgagttgcacagttccatgggaaaagcagtttccctggctgggtagtgcactaactcaccacccaccttggcttgggggaggaggttcccctttcccggtgtggctctcaggtgggccccacaccacactgttcttccgaattctctccatgggtcaagccagccttctagtcaattttgatgagagaagctggataccttggttactggtgatgattttttttttttgatgggagcctccgaacaccactgctatagttggccattgtggcccctttcccccgtgtttacattttcatttgtctcaagatatattaaaattttctaatttctttattcacccattggatgttcaggagcatgttgtttagtttccatgtatttataatttttctgaaaaagttctgttattgatttctagttttatacgattgtggtcagaaaagatacttgatatgatttcaatcttaaatttgctaaggattgtcttgtggtctaacatatgatctctcctagagaatgttctgtgtgcatttgaaaagactctatcccttcagatccttgaatattcgctttacatatttaggtgctccactgttgggtgtatatatatttacgattgtaatatcttcttgataaataagtcctttattattacaaaatgtctttttttggtctacttttacagtttttgacctaaagtgtattttgtctgatataagaattgctactcacactcacttgcagtttctatttgcatggaatatctttttccatcccttcactttcagcctatgtgcatccttaaaaatgaagtttcttgtaaacagcatatagctggcttttctttttttttaattcatgcattcacatgatatcttttgattagaatatttaatccatttccattcaaggtaattatagatatgtggaaactttctgctgccattttgttaattattttctgattgttttgtccccttttcctctcttgccatcttcctttaagacttaataattttctatttcctatggtgatatgttttgaatctttaatttttgctttggttatcatgagaattttatagaatatcttacatttataacagtctatttcaaactgaaaacagcttaattttgattgcttacaattcttctacacttttattccccccctcaattttatgttttcaatgcctaaatttacattcttttgtaatgtgtgtcccttgactattttagctatagtcattattaataatttctttaatccttgttctagagataaaattactttatataccaccattatggtcctgagtattctacatattgtctgtattacttatactattaggttttgtgcatttgtaagttttatgttattaattaggagccttttgtttcagtttaaagacctccctttaacaatatctataagacaggcttgttggtgaagaacttcctagcttttgtttgcctggaaaagtttttattactcccttatttctgaaagacatttttgctgggtaaagtattcttgtttggcagttttttccctttaatatttaaaatacatcgtcttatttttaaatagtctgcagggtttttgctgagaagactgctgatagtcatattgggacttttttgtatgcaatgtatttcttttatcttttgttgctttcagaattttccttttgtctttgatttttgccagtttgattattatatatcttgataaattcctcttttggtgtaatttaatttgtgacatctgtacttagtgtacctgaattttggctttttttccctgatattaggaagtttttatccattatttccttaaatatgctttctggccctttctctttttcttctcctggaatgctattaagcatagattaggtctcttgatggttcccataattcctatgggctatcttcattctcttccatctgtttttcattttgcttcttgattgcataatttcaaatgattcatctttgaatttactgactctttagcttgatcaagctggccatttaagctttctattacatttttttttccaattcagtcattgtattcttcatctctaggatttctatttgtttttttaaaaaattagttctattttttttgtcacagctcatgtgaaaagaaatatggaaacaattattttccaaataatttaattttttatctttatattcctgaagctcactaaactttattaaaaaggattattctgaatccttttcctgtcatttttaaacttcctttttatagtggtccattgttgtagctttgttagttttttctggagatgtcatgatatccaaagtctttgaattccctgtgtttttgcattggagtttatgcatttacagaaaaggtcacttttttcagcttttacaggagttcttggcaggtaaaaaccttcactaattagtctagataatgattctaaataggccagtgggtcataaccctggaaagcacagcttcctttcagatcctctagatggctaggctgctgcctttgctatgaagtcaggtgaggcacctggctagtctctgctatttggcaagaccacaggctgaactctgctatcaggctgggctgctatataggcactgcatctacttctgatttgggtgagccacaggccatattccttggctagaggtactgatatttgagttcagcagttggacagggttgcaggagaggctccagggttaagtgaatcagaatggatgaaccaactactatgctcagtaaaaatccaagactcagatttgcctccttccctgtgtaggctctgggggagcacattaaacttctgggcatgggaaaacagtgcctatttgcccaactgcagtggttcagacaactgcagtggttgtcttccttcttaggtggggtctggtggtagactttgaggctgtggggaacactgattaagctcttagatatggcagatctaatacctttttgttgtggaaatttgcttgtggtagatctccgtccctggccagaaccctggggtagggtctgaggctgggcctggaggttaaccatctagggattcaagccagatagcacttccaaccacttctgagagtgaccaactcagctctgcaggtaggctatgctattagctagtacccctgattgaataccactgcttgatatattgagcttacatcaaaatctgcatgctggtctctgtgagcaatacctctttgctttgtttctatctgaccctaggtggtctagctgtgcagtttcctcctatattttctgttccccatgaggaaaaatgaaatgggtttcctgggaagcatctcagtatgttaaagaagctggatgtctaccacccaggttctctttccccactgtagaaaccatgagccctggaggatcctctctgtgtgggactgtgccaacttgggggagggagaggggtgacatggtcaaagtgagaccatttctcctactttttaatgcaaatttttattcagtttcataagtcatgcaggtgattctggcttattcccacatgtttgggttttcatcaaggtgtttttgtctgtgggtaattgctagttagtatttctgtggggagagtgaagcctgcaacatattattccaccatattgccaatgtcactctctccccagttctaaatgtttatgcaactcatgacagaacttcaaaatacatgaggcaaaagtggatggaattaaatggagaaatagacaaattcaaaatttgacttttgtattttaatagtcctctcttagtaactgctggaacaagtatacaaaaataatcaatgaagatacagagatttaaacataactaataaaatgaacataactaatatttataagaaattacactaaactcctgctgaatacacattattttcaagcaaatgtagaacattcataagataaaaacatgtgctattttatgtttataaaacgagataggtcataaaccaagtcataaatttaaaagtatctttttttcaccacagtggagtgaaattaggaattgattaaaaaatcctcaaaaatttacaaacatttctaaattaagaaacacacatctaaatagcctatttatcaaagaagaaatcaagagtaatgtaaaatttttaaagtaaattatagtaaaccaacaacatattgaaattgataggatgccattaaaataatgttcagtgggagttttactgttttaacctaatcagaaaacggcaacgagatacaatcaatcctgtaagttttaccttaagaaactagacaaagaagaaaaaattaaacacagtaagctgaagaaagaaaataaagataaaataaaaaaatcaatgaagtggtaaatagacaaacaatagaaaaaaaatcagtggaacaaaaaattggttcttggaaaagatcaataaaattgaaaaaccgctggctagactgtttaaagaaaaaagaaataacacacaaattgcaattgtccagaattaaatatgaggcaaatctgcaaatcttattgacattgaaaggataacaataggatattataaataatttttgaataataactataataacttagataaaataaaaatatcttagaatatattacttaccaatactggtacaagaaaaaaatcaggaaacctgagtagatctatacatatcaaagagatttaatctatatttaataacattcccacgaaaaactccattttcagatagcttcacttgtgaattctatcaaatgtaagaaaatgtaatgactaccttaactaactcaaaacacaaagcagtcagatctggcaagatggctaaataggaaaagctctggtctgcagctcctagcgagaccaatgcagaaggtggttgatttctgcatttccaactaaggtacccggctcatctcattgggactggttagatagtgggtgcagcccacagagggcgagcagaagcagggtggggcatcaccacacccaggaagtgcaagaagtgggggcctccctttcccagccaagggaagccatgagggactatgctatccagcccagatactacgcttttcccatggtttttgcaacccacagaccaggagattctcttgtgtacctacaccaccagggctctgggtttcaagcacaaatctgggcagctgcttggacaaacatcaagctagctgcaggatttttttttcccccccggtgactcctggaaccccagcaagacagaactgttcactcccctggaaagggggctgaagctggaaagccaaatggtcttgctcagcaggtcccactcccatggagccctgcaagctaagaaccactggcttgaaattcttgctgccagcacagcagtctgaagttgacctgggatgatcgagctagttagggtaggtgcatccaccattactgagtcttgagtaggcagttttcccctgactgctaaaaaggcctggaagttcagactgcgtggaacccaacacagtgtggcaaagcaactgtggccagagtgcctctctagattcctcttcactgggcagggcatctctgaaagaaaggcagcagccccagtcaggggcttataaataaaactcccatctccctgggacagagccctgaggaaaggggcagctgtgggatcagcttcagcacacttaaactttcctgcctgccggctttgaagagagcagtgtatcctgacaaagagggttctcccagcacagcgctcaagctctgctaagggacagactgcctcctcaaatgggttcctgacccccatgcctcctgactgggagagatgtcccaacaggggttgacagacacctcatataggagagctccagctggaattaggctggtgcccctctgggatgaagcttccagaggaaggagcaggcagcaatctttgctgttctgcagcctccgctggtgatactcagacaaatagggtctggagtggacctccagcaaattccagcagacctgcagaagaggagcctgactgttagaagaaaaactaacaaacagaaagcaataacatcaacatcaacaaaccaaggacccccctccaagaaaccccatccaaagatcatcagcctcaaaaatcaaaggtagataaatccaaaaagatgaggaaaaaccagtgcaaaaatgctgaaaattccaaaaaccaaaatgcctcttctccaaatgactgcaactcctctcccgcaagggcacaaaactggacagagaatgagtttgatgaattgacagaagtaggcttcagcaggtgggtaataacaaactcctctgaggtaaaggagcatgttctaacccaatggaaggaagctaaaaccttgacaaagagtacaggaactgctaactagaataaccagtttagagaagaacataaatgacctgatggagctgaaaaacatagcacaagaacttcgtgtagcatacacaagtatcatagccaaatcaatcaagtggaagaaaggatatcagagactgaagatcaacttaatgaaatagacatgaaaacaagattagacaaagaagaatgaaaaagaatgaacaaagcctgcaagaaatatgggactatgtgaaaagaccaaacctgtgattgattggtatccctgaaaatgatggggagaatagaaccaagttggaaaacacacttcaggctattatcctggaggatttcccaagctagcaagacaggccaacattcaaattcaggaaattcaaagaacaccattaagatacttctcaagaagagcaaccccaggacacatagtcgccagattctccgaggttgaaatgaaggaaaaaatgttaagggcagtcagagaaaggttgggttacctacaaagggaagcccatcagactaacaacagatctctctgcagaaaccctacaaaccagaagagattgggacccactattcaacattctcaaagaaaagaattttcaacccaaaatatcatatccagccacagtaagtttcataactgaaggagaaatagaatcctttttaaacaagcaaaagttgagagattttgtcaccaccaggcctaccctacaagaggtcttggaggaagcactaaatatggaaaggaaaaaccagtaccagccactgcaaagacacaccaaaatataaagaccaatgacactatgaagaaactgcatcaactaatgtgcaaaataaccagctagcatcatgatgacaggatcaaattcacacataacaatattaaccttaaatataaatgggctaaataccccaattaaaagacatagactagcaagttggataaaaagtcaagacctatcagtgtgttgtattcaggagacccatctcacatgcaaagacacacataggctcaaaataaagagatggaggaatatttgccaagataatggaaggtaaaaaaaggcaggagttgcaatcctagtctctgataaaatagactttaaacaaacaaagatcaaaaaagacaagggcattacataatagtaaagggatcaatgcaacaagagaagctaactatcctaaatatacatgcacccaatacaggagcacccagattcataaaacaagttcctggagacctacaaagatacttagaccataacatcactgtcaatattagacagatcaatgagaccaaaaattaacaaggatattcaggacttgaactcagctctgggccaagcagacctaatagatatctacagaactcttgaccccacatcaacagaatatacatttttctaagcaccatatagcacttactcaaaaattgaccacataattggaagtaaaacactcctcagcaagtgcaaaagaatggaaataataataaacagtctctcagaccactgtgcaatcaaattagaactcaggattaagaaactcactgaaaaccacagaactacatggaaactgaacaaccagctcctgaatgactactgggtaaataattaaattaaggcagagatagcgaagttctttgaagccaatgataacaaagcaacagcataccagaatctctgggacacagataaagcagtgtttagagggaaattaatagcactaaatgcccacatcagaaagtgggaaagatataaaatcgacaccctaacatcacaattaaaagaactggagaagcaagagcaaacaaattcaaaagctaacagaagacatgaaataactaagatcagagcagaactcaaggagatagagacatgaaaaactctgcaaaacatcaatgaatccaggagctggttttttgaagagattaacaaaatacatagaccactagctagactaataaagaagaaaagaaagaatcaaatagatacaataaaaaatgataaaggggatatcaccactgatcccacagaaatacaaactaccatcagaaaatactataaacacctctatgcaaatcaactagaaaatctagaacaaatgaataaattcctggacacatacaccctcccaagaccagaaagatatcgaatctctgagtagaccaataacaatttctgaaattgaggcagtaattagtagcttacccaccaaaaaaagcctgggaccagacggatttacagccagattcaactcaagatggattaaagacttaaacaaattctacctctgtccagcatcattctgattccaaaacctggcagagagacaacaacaataaatttcaggccaatgtctgtaataaacattgatgcgaaaatcctcaataaaatactggcaaaccgaacccagcagcacatcaaaaagcttattcaccatgatcaagttagcttcagccctgggatgcaaggctggttcaacatacacaaatccataaacgtaatctattacataaacagaatcaatgacaaaaaccacatgattatctcaatagacgcagaaaagccctccagtaaaattcaacatttcttaatgttaaaaactctcaagaaactaggattgatggaacatatctcaaaatagtaagcgctatttacgacaaattcatagccaatatcatactgaatgggcaaaagctggaagcattccctttgaaaaccagcacacgacacgatgccctctcactactcctattaaacatagtgttggaagttctggccaaagcaatcaggcaagagaaagaaataaagggtgttcaaatagaaatagagaagtcaaattgtctctgtttgcagatgacataattgtatatttagaaaaccccattgtctcagcccaaaaactccttaagctgataaacaactttggcaaagtctcaggatacaaaatcaatgtgcaaaaatcacaagcattcctatacaccaataacagacaagcagagagccaaatcatgaatggacttctattcacaattgctacaaagaaaataaaatacctaggaatacaacttacaaaagatgtgaaggacctcttcaaggagaactacaaaccactgctcaaggaaataagagaggacacaaacaaatggaaaaatattcgttgctcagggataggaagaatcaatatcatgaaaatggccatactgccaaaagtaattacagattcaatgctattcccatcaagctaccactgactttcttcacagaaatagaaaaaactactttaaatttcatatggaatgaaaaagagcccatatggccaggacaatcctaggcaaaagcaacaaagctggaagcattacactacctgacttcaaactatactacaaggctacagtaaccaaaacggcatggtactggtaccaaaacagatatgtatatatagaccaatggaacagaacagaggcctcagaaataacaccacacatctacaaccatctgatctttgacaaacctgacaaaaacaagctgtgggtaaaagattccctatttaataaatggtgttgggaaaactggctagccatatgcagaaaactgaagctggaccccttctttacatcttatacaaaaattaacttaaggtggattaaagacttaaacgtaagacctaaaaccataaaaaaccctagaagaaaacctaggcagtaccatttaggacataggcatgggcaaagactttatgactaaaacaccaaaagcaattttaacaaaagccaaaattaacaaatgggatctaattaaactaaagagcttctgctcagcaaaagaaactatcatcagagtgatcaggcaacctacagaatggagaaaatgtttggaatctatccatctgacaaaggtctgatattcagaatctacaaggaacttaaaccaatttacaagaaaaaaacaaacaaccccatcaaaaagcgggtgaaggatatgaacggacacttcacaaaagaagatatttatgtggccaacaaacatgaaaaaaaactgattatcactggtcattagagaaatgcaattcaaaaccacaatgggacactgtcttactccagttagaatggcgatcattaaaaagtcaagaaacaacagatgttggtgtggatttgagaaataagaatgcttttacactgttggtaggagtgtaaattagctcaaccattgtggcagacagtgtggccattcctcaaggatatagaaccagaaataccatttgacccaccaatcccattactgggtatatacccaaaggataataaatcattctactataaagacacatgcatacatatttttattgcagcactatttacaatagcaaagatttggaaccaacccaaatgcccatcaatgatagactggataaagaaaatatggcacatctacaccatggaatactatgcagccataaaaaaggatgggtttatgtcctttgcagggacatggatgaaactggaaaccatcatcctcggcaaacgaacacaggaacagacaaccaaacatcacatgttctcactcataagtgggaactgaacaatgagaacacatggatacagggagaggagcatcatacactggggcctgttatgaggtcggggccaaggagtgggagagcattaggacaaatgcttaatgcatgtggagcttaaaacctaaatgacaggttgatggttgcagcaaaccaccacggcacacgtatactgatgtaacaaatgttcacattcagcacatgtattccagagcttaaagtaaaataaaaaataaaaagcagaatgtgaaaaaaagcaaagaagtcaaaatttttcagctaagttaatgaggtcaatgtaaccctcataccaaaataattgaaaaaacattatgaaaaaatatattacagattaatatttttcatgagcatagagataaaaaatttttatcaaaatgttagctagtcaaatcctaccatatataaaaagcataatacatcatgactaagtggatttacactaggaatgtaagaatcatttaatatttttaaatgatttaatatatttcttcatgttaacaaaataagggagtaaagtcttgatcatctcaataaacaacactggcaaaattcacggcctatttaagattaacataaataaataaataaataaataaataaataaataatctcagcaaactaagaatagaaggcaacttcttcaacttaatgaagaatatttttgaaaaaacctaaaagtagcatcatgttaatatgaaagacttgattaccataagatccggataaggagagcatatcttctcctaccaattttattaaacatttgtaatcaggatcttctctagtgcaataaggcaaaaaaaaaaaaaaaaagtaaaagttttgcacattggaaaggagaaagtaaaatgtcagataacataatctgtgttcataacaattcaaagaaatctacaaaaaagctactagaacaaatgagtttaatgatgctgcaggatacaaatcaatatttgaaaatcaattgtagttttacatttcatctataaaaccatgtcatttacaattgcataaaaactattttgtgatacatttaacaaagtatatgcaaatccatgattttaaaagtatagtactttgctaaagaaagtgaaatgttttataaattaaataaagattaactaagtagggagatataccatctccattaattggaagattcaatatttttaagacataaatgatccccaaattgttctacagattccatgccattgcaatcaagattgcagcagctttttccttcttttttattttggtagaaatggactgattttaaaacttatataccctgaaaacagccagaataatcttttttttaattttttttttttttttttttgagacggagtctcgctctgtcgcccgctaattttttttttttatttttagtagagacggggtttcaccgtgttagccaggatggtctcgatctcttgacctcatgatccacccgcctcggcctcccaaagtgctgggattacaggtgtgaaccaccgtgcctggcacaaaataatctttaaaagatttacagtaccacatttacactatctcaagtcttgctataaagctacagtaagaatacttacaatgtcttcatttgtaatagcccagaataagaaataactcatacatccatcaacagaagaatgagtaaacaaacagcagtatattcatataatggaatattactcaacaataaaaagaactgatataggcaaaaccaagaataatctcaaaggcatagtgctgagcaaaaaaaaaaaaaaaaaaagcaagctataaagagtgcatactgtataattctactgatatgaagttctagagtacataaaatatagaatagtataaatcagagcagtggttgcctctggcaagtgtgggggtggggattgactgagataaggcgggagggaaatttctggggtgatggaaaagtttatatcttgttaggaatgtggtatttacacaggtatatgcatctgtcaacatcatcaaactgtatactgtatgtaaattatatttcaataaataatccatttttaatttgaataaatagatactactctgtatttttgtgtgtttttaaaacaaatattgctttgcttttaagtacacgcatttaaaaaataggctaatcccagaactttgggaggcctaggcgggtggatcacgatgtcaggagttcaagaacagcctggccaagatggtgaaaccccgtctctattaaaaatacaaaaattagctgggcatggtggcaggtgcctgtaatcccagttactcagtaggctgaggcaggagaattgcttgaacccaggcggcagaggttgcggtgagccgagatctcaccattgcactccagcctgggcaatagagtgagattccatctcaaaacaaaaaacagaaaacaaaaacaaacaaagaaacaaatatacaggctagtacctagatgtcttgtaggtattcaaggcacataagctgtgtgtctatattttagcaaaactgggttcacagtacataattgcaaagtaaatccttgttgattgataaaaaatttaaaaattgtcttttgcattatgtagaattttattagaaatgtgggttagtgagggaggatgggttggagtagcagttttaaacatgttagcaagaccttcacaaatcccaagaaataaaagtagagcaggaagatgcggtctttttaccaggtgacagtcataatatttgtaaaatagggtcatatcttaaccatgttgaatttttctgtgtttaataacacctagcagaaagtttagtgtatatttgaggaattaaaataaccaattttctatggcaaaccccatttagcaagatcaaattttatactttaactattttttcaaatgttcttttttgtgtcccaaaacaagttattcaaaacataaattgacccccaaaaggaatacatgagtttgaagtagggagattcaaattacatattgctaagaaatactttcagataacttggtttctcaactcaaggaatatgcttctagcttttcttcttcttctccttcttctccttgttccccttctttttcttctctttctccttcttctccttcttctgcttctgtttctgcttctgcttctcttcttcttcttttttttttttgaaatcttgaaggaattagtacctatttccatggaattagcccaattttcttcctcttcctggtattgagtatgctatgttaaaataaagaggaggctgggcacagtggttcatgcctgtaatcccagcattttgggaggctgaggcaggtggatcacctgaggtcgggaatttgagaccagcctgaccaacatggagaaaccctgtctctactaaaaatacaaaattaagtgggcgtggtggtgcatgcctgtaatcccagctacctgggaggctgatgcaagaggattgcttgaacccgagaggcggaggttgcagtgagccgagattgcaccattgcattccagcctgggcaacaagagtgaaactctttctcaaaaaaaaaaaaaaaaaaaaaaaaaagaagaggaaagagatctcaggcatggatacacaggttcatgttgggaatggctaaaagtaacactggttagcaggtttgaagttacttccaattctctttctcattcattcaaaatgttcattggggaatggtataacaagacaatgtgctcagtgctagtcataaaaatgaacaaaggaaagttagtaccctctaagagatccacaggccagtggaaaagacaaaatgaataactgaatacataactgaatatatgattataagcatactccattctattattgtttataaattaatttctgtattaatcattataaccatatacagggcatctgtctggtgttttacagatgttgttctatttgtaccttcaaagtaggtgttatcctaatttcagagcagtggaaaccaaggcttagagaggatataccacagacatgtctaggatgtagttaagatttgaactcattctgtctgactttctagtcctcagtctttcaaccagagccctctaccatctaagacggactttagccaaacttttcagcctgcagtatgaatgcataactttgtaaccatgcccagggtaaaaaacttcaaaggagcttgaaactgattttcccttgttttggtaatttgtattttattctttcttaaactcggataaataaataatcaccaaacacacagaggaaaaaaatcagatttgttttgtgttagccatatgtttccatttaaaatatcatgttgggagaggatggtggttaggagcagcaggcatgtggtgattttgcacataatggcacatgctgggtctgtgttctgacaggaagtttcagcttctctttgaagctgtgctttctacttagtggagtcatgcaaaggctttctttgtcccaacttcaattctatagcaaccagagtagatgattggcctgggcactaagagcctcgtgcacaatttagtgttgtaaacgtgttggctctctgctatgctgaagagactgagctagctgctgggagggctacagttccttggtcccttgctatcctgtagcttgctttctggtgggggaaagcctcctatgacgagggatatattaagactaagagaagtcagagcataatgctctaagagcgtgacctccagtaatctcaaaggagtactaattgtcaaggggaagctcactttcaggcagaagcatgaagaaaggaaagcaaaatttattgactgtactatgcaatattgcttactcctcaacacaacaatgtgagggatgtgcacttcttgtatttttttttttttttttttgagatggagtctcactctgtcacccaggctggactgcagtgacacgatctctgcccactgccaccactgcctcccaggttcaagcaattctcctgcctcagcctcctgagtagctgggattacagccaccatacccaactattttttaaaaatatttttagtagagacagggtttcaccatgtcagctaggctggtatcgaactcctgacctcaagtgatttgcctacctcgacctcccaaagtgctgggattataggtgtgagccaccatgcctagccttgtatattttttgtttaaaaaatgagataagtgtaactgaaaattaaaaatgtgttagagcatatacaatgaaaaataactcctcatctcacttcaatctcttagtctatccccaagagcaagcagagtaaaagattcctgtttattttcctggtaatattctaattaaatgtatgtgcatttcattgtatgcatcctttatttctatacaaataagagtacactaaataccctgttctggacctgacagttttccctcaacagcatatcctaaagtactttaagtgacaataggtacatatggcttcacctgtatatttttgtttgttcgtttgtttatggctacatagttttcaatatatacgttggatttttgacagaccaataaatagtgtccctctatctctgcccccttcccatgggttctgaagagtttgagaaggaaaacaaatagttggcataaggaggccacaaatttaattttattgcagatagaggcaagactagaagttagagttttgtgtgaatagtcaagcaggcttgttattactgaagctgtgtatgtagatcttgttgtgtagcctacagcagttcccaaaatgaaaagtacagttgggacaagatctaccagtcagataagtgataccaccttctcacaggtggagtgagtcaagggcaaaagcaagatcatcagggtgctttaaaaactcctttgcacaaaaacctgaatagagtagaaggtactcctctctaactgtataggcggagagcatccttatttagctagtcccctgtggatggtagtttaggttagttccattcctgctactgagcatgcatttttgttattctttttcttttcttttttttttttttttttgagtctcaccctatcacccaggcaggagtgcaatggcgcaattttggctcactgcaacctccacctcccgggttcaaatgattctccttctcctgcctcagcctcccaagtagttgggattacaggtgcccgccaccatgcctggctattttttgtatttttagtagagacggggtttcaccatattggccgggctggtctcgaactcctgagctcgtgatccgcccacctcagcctcccaaagtgctgggattacaggcgtgagccaccgcacccggcctgtcattcttttttttacagaaaaagaaactgtggttctgtgagtttaagtgttcatggttacacagctaatgagagggggagtcagaattctgattcacatctgacttcaattccagggctcatcatttctcacatcctctactcacccaattactagcatctgtatggaaaatcagtaagagtctgagtccatttttactaaatcagtaacagtctgagtccatttttattaaatcttcttattgttttcctcataatccccatgtgaggcagttgaagcaggagtatggtctctattttctagaaaaataaatggagattcaaaaaggttgttacttctttacttaacatcactagttaatggccaggtctaagactcaacctcctttcacttcagacccttctcctgtatgtcagagagccttggactagccagtgaaatatgaatgcagaccaagggattagtgttatcggtggcacgttgatgggaaagagcggtgtttgctccaggagtgacaaggagtctcctttcaatgatatctagattatatcctttttaggcatctgtgtttgtggtctgtgtgtcagagcttcctgggaaatgtctaaaatgtaaattcctagacttcacttagacctacagactatatggaaagaaaacctggaatctgcattttaacaagatacctaagatattctgatggaagttagtctatgaattgggatggaagaaccctgctttgaggaattttaaaaagttttgttttttggtatatagtaaatgagtcataatcagaattgtgtcttcaggcagtgtgttattgtggaaagaacatgggctttggcattagctaaacttaaattgattcctcattctgccatttattaggtgggtgaacttggagaagttatgagtctcactgaatctcagccagctcacgtacatcacaggtctgcaatgaggattaaatgagatgatgtatgttaagagcctgccctcaggctctacaaatgtgacttcctctccattttgttttcttctagtatttttttcaataatctatctcatcttctccacccatgatcactctgaaagcagtttcttggttttatttatcatctcattgctattacttatggtccctgctatagaaaaaaaggacagatgcccagcagggtcaggttttctttaaccagactgctgcatgcacaggccttgttactctactcgttctgtaagatccatggaggaagataagcaaagcgcgtttaccatgtgccttctcagaggacatgtacatttgttagtgaattctgagtcattaacaaaacgttgccttaaaatggtttgcattaaaatgaaattttacttgtgttccttaaatgtcttggaatgtgctgggactgctgtaggcaagctttggaagcaggcccttctcattttcctgttaccttccatctctctgggttcagtgggcttcagtgtgttcagcagctaccagggctcacctaagcagcatttaggatctttcctttctcttgttacagcttcaaacctgacagctcctgtgtgcaacccccttagcatcctctaaggaacacagtggcttacacctgtaatcccagcacattgggagcccaaggcaggaagattgcttaagtccaagagtttgagaccagcatgggcaacatagcaagaatctatctctacaaaaaaaaataaaaaattagccaaacctggtgacatacatccgtggtcctatagctactcaggaggctgaggtaggaggatcacttgagcctgggaggtcgaggctgcagtgagcaatgattgtacaactgcactccagcctggccgacagagcaagatcctgtctcaaaacaaaacaaaactaacaaagacaaaaaccatgaaacagtcccaacaagggtgttcattctaatcataacttggtatggtaattgcctgccttttgaaaagagcctttataaaaagtaaaacaaaatgaaagaaaaccactgaaattttgtatatcttagcagctttaggacaacatcatggaagagggtaaagttccaaaaaaataataataataataataaccttttgagggagtgcataatctcgagatgggtgagacttgctttacaaacatattcatgtctttaatagacagaagaacaagatacaggaatagaaagataggaacattcttatggaaacagtgtgaggaaatagtctacatcacaattagactatatatatgataacagatgtgaacctagtgctgtaaaattatacttttaattttgcaaacttcaatgtgcaattaacctgaatttttacctgatagaaaagtgatttacttaccatgaacaatcactttaaaagaaaaaacaacaaagataaaatacacttataaaacttacttttctttcttatgacaaaggcaatacacatttttagttgaatatatagaaaatatttagaaaatttagaataaaagaagaacataaaaagtacagcaccccaagatcattactgcttacattttcatgtatatccatcgactcttttcttctatccatgtagtcatacttgagagagtcaaaaatggaatcataatatacatatttttcttttgcttaaaaaaatacagcatatgccagtgcttctcaaatggtaatgcatgtagaaatcatttggggaactttgttaaaatgcagattcctattcagtaggtctgggtgggacctggaattctgcatgtctaacaagttcctgggaagcacatgctgccggtcgcgggaacacacttggagtagcaggtgtgtaccccattacatgtcattactgattccttaccaagttattattattatttgagatggagtcttgctctgtcacccaggctggagtgcagtagcacaatttcggcgcactgcaaattctgcctccccagttcaagcaattctcctgcctcagcctcccaagtagctggattacaggagcatgccaccacgcctggctcatttttgtatttttagtagagatggggtttcaccatgctgaccaggctggtctcgaactcctgacctctagtgatctgcctgccttggccttccaaagtgctgggattacaggcatgagccactgtgcctggccttaccaacttatttttaatcactgcaaatcttccattatacaatgtatgtatctcaacactgtcatgaaattggctagttaagtttactcctttgctcttattataccagaaaaaaaactatgatagacatttttggggtgagaaatctttacacatgtccattgacatttccttaagggaattttcttgaaatggaagtgcttcatcagatttattcagaattttaaaaacatttaatacacactgccaactagctcttaggaagaaaacaatgcagttttgaaaggtacacattaaccagttagttacattaccttgacctgaaatttcttttggtttgttgtttccatttccataataaccccactgagttctcttgtatcttttttagtattctataatcgatgtttgctcatgaggatgtctgccccaagctggccagactattagcctgaatgctcagcacagcactagacgctaaagagatgagagaaggatgaatagttaaatggaaacatatgcctttcactagataaatacttctttagagcactgtagtggaggcagtatcaatttaatttctgacacattagacactttgaccactaattaaaacctaagcatgaaaaattacttgctgcttcttatggaaaataacccacaacatcctttggcgttaaactatttcctaaaactcccaaatctgtgcatagctggccaaagttttaaaactacatgcaccaacaccggtgggctgttattattatgcttaaggttttattagtggcattacataataatgcttttgtaatattttgatataatatagctcatcatataataattctcatataatattttgcaaatccatcccacacggaccatgtttttatttatatttgtggtattttattcatcatgattttttgtattaattttgatttttaaaaatatctccttaaatgttacttggaccccttaagtcttgcacccaatatgactgcctgacttgctttaccctagttctagtcctagaagttaactgtaacttaagatttttgagcagtaagatgaaagttataacttaaattttatacaggtaatatcaagtaatatcacttaatcaaataacatttgctttaatttttactggtatagttaattatttttcttctaggtgttactatgtaatcaagaacatattcaagtcactgtacctgtgggcgtggtatgaaatatgcttgcttttcgtaggcaacaacaggggacgttttgagtcagggagctattcataccaatactttcctttatccattcaaagttcttccttttgttcaattactaattcaaaaaataccctttgattgctgttgtgtgataggaaccatgacaggtaaatgctatgtatgaataaaaatgagtaaaacataatgtttaccatcaagttgttccacgtttgctagtggagggacacagtccgtatgaagatcaaattaaacccagagtttaaatgggaccagagaggaaagatggggacacctggaacacaggaaagatgtggtcatgcctaagttgtctcttcaggagtgaattttgtgcatgtgttacactcaccacacgccaccacacacacccccacacaaacacacacagagatgcattctttagaatttagcccataaccattgccttgggaagacttagatgttttggccaatgtacatttaatctaggtcaaattttgcaaaacaaaacatggagtgcatttgtttgagcaggggaataatgctgtcttggtcttgaagcccatatggcatcatgcatagattgagaatcatcatgtctgctgaattatgttatcactgacttcaaagtttatcattgatgagcagcagctgttgccaggaatagtaaatcacatcttgcatttttataagaaatggtatcatggcttttctgaataactgatttttaatagaaggcataagtcatcactacactatatataggaagggtatagatttacttattcatttttgacaattttatttgatttcaaaatatttcattgaatgttcactatgtgcacatgaataagcttaagtccctatttttaaggagcttaaaatccatttaggaaaaggacatgtctgtaactagagtttaaagcccaatgtcgtatgtgttgagtacagatacaaatcacttggatgggaaatgagtgggaaaaacaaaaagctcaggccagaactagggaagaaaagaggactttgtagagaagggagcatttggctcgaactttgttggctgtgcaggatttgtttcatttaggtggtaaaacactgcaaggcatttgatgccaagaagataggatgggcaagaaaattatgaaggtaaataaatgccagtttggggaattgggaagtaattaggcattgctattgatcagtgcttctcaaccctggctgcacactggaatcatcaggagagtcttgaaaatactggtgcctgagtttaaccctcagagactctgatttaattggtttttggtatggcttatgcatcagaatttttaaaagttccccaaattattctcatatgcagccagggttgagaacttctgctgtagactaataacttagcctggttctacgggaggtaaggcaggaaaaaaaaaaaaaaaaaaaaaaaggaaaacagaacatgcttttcctgtgctgaaaaagagcagagaatttaaaagaatattcctattagttcatgtggaaaatgttaagagtcagggattctcatttacatttacaaatgaaaaaatgagctagtcaaagaaggcttgaaactaaggtaacatgaccggtctctagaactcatcgtgagaaaggacagggtttgaggataaggagagaaaactttgattacaagagtaagaaaattataatgaaaagaggagtcagcagtttggctcttcatgtttgtctttggcttgaattggaaagtatggaaacttcatctaaaactagtcttttttttttttttttttcctttcatcaactaccaaatgtgtatatgagaaagggcacacacaaagggaagtgaataaagtagggcgggtgagctttactcagaatagatgaaggggaagtacacagccactgtgatatcctttctcaccttgaattggtcttgtaggcacaaggcttcctggattcttgaaaaattcctaccttctcaccattcaggtcttgttaattctgccttcttaattcagtagtgactcctacattctgtcagatgatagccttctttaggaaacaaaacgaaacctgctcatccaaaacttggataaatacgccgggtgcactggctcacgcctgtaattccagcactttgggaggccgaggcgggcggatcacttgaggtcagttgtttgagaccagcctggccaatatggtgaaacctcatctctactaaaaatataaaaattagctggacgtggtggcacatgcctgtaatcccagctactcaggaggctgaggcaggagaatcccttgaaccccagaagcggaggttgcagtgagccaagattgcttcattgcactccagtctgggcatcacagcaagactccatctcaaaaacaaacaaacaaacaaacaacaacaacaacttggaaaaataaaattgaatcttcttcttcaaaaaatatatatacttccaagccagtgtttctcaacttttgggattattctagcactcagacatgcttcagccatgacatgctcacccattccccactgcagttacaactcttcacactgcattgtgtgctctttaatggtcccagtggtcatagttgttttgttttattttcattgcctagcacaatgccacacatatattcaataaatgtaatacttttacttctaggttccaaacaagaccttgtttccatggacttgtaatacctaaataaagaacaaactcttgtaacatttaattttcattaattttctgtctttccatattccatagtgtcctcccacttcattctggttttcaccataaaagatttagtttataacagtttttttttttttttgtggtagtaaatatctgaatttttttcccttcattgttatctttagtgaacggctcttgcaggaagtttatcagtgtcaactcactcatctgcatctgaaacgttcgatgatggattgtcactcaagggaaccattatatttccatacgtagagaagttcctttgccaatcacaacaaaatgatacaataaccgttaatacagaaagaatgagtatgcctctacctgctcttatcttactgcttctctttaggtcctactcagtacttcctttctaaagagacagcttcctaatttccctacctcctaatgtatccactgtcttccctctccatttccttcaaatacataactgccagatacatttttcttaactagaggtatgatagtcattttcttactcaaatctttcagtggatctctatttctaactcagatgtgtccttctgacttggatatttgtaaagaacttcacgctctcgcccagctttcccttcccgaagcttgtcctgctcacctttacatgaggctccagcttattgtgcctattaggtgcactttcaatacagcacattctttcctgccaccttggctttgtcttagctacttccttcctatgaaatgtctggattcccatcaatagaacattaactcatcctcaaggtcagttcaaaatcagttccttcatgaggaattccccaattcctgtaaataaacatgatctctcccttcctaatctctccttagattaggaaatctcagttctgagaaatagaactgtctttctgtttctctcagggtcttccgcttggcttgttttataaatatctatagcctacactatctcctgagatgataaaggccttgaggaaatggtaggtacatttggtacctaccttgaggaaatggtagcaacacagtaggcatgcctcaagtatttgagacatgtttccttaaagtgtagtgaaatattagggcttagggggataagttatattcttttacattcgaaatattagaaaggaagcctaatgggaaggcaaagaaattacctaatatagggctttgtattcctataattttgaactctaaaatcactatgtttttccttgcaccagccttcacctccctacccccatatacacactcacatatgtacacacgggtatagaggggacttttggtctgcataaaagataagcagactaactcactatgattattctgaatcagataaaaatatgtaacacccttgacatgaaaacagtctttggtgaagaagaaaaacttcattaacggttctttaaaacagttataatccctttactatgctactttggaaaggaaatataaaacagtatgattacatatttaagaagaaaactataatgtatttcagctcctcctggtaaaatgtggaataaaaagtaatctggacctaccaaaaaaaaaaaaaaaaaaaaaaaaaaaaaaagcccaaacagcttctgctcagtacacggcaaaactgtgaacatttgaacatttagtgacatctgggcaagaaaagtcagccggaaaaacaatctgtttttgtgacacatttttgagatgaattcaaagagcaacttttaaggacaaaaaagcaaattagtgttttatgttggggagaatattttattcttcctttttcagggctgcaactcagtaaccgcatcccatataatgctggcacttatgtctcataaatactctgtaggtttagtgacatggctcttctgggagctttccctaggcaactaacattgccacttctagattttgctttcaatgataggcctagtaaaagttggatgtccctgatatgtaatggtaacaactgaaaatgccattctaatattttctgtagcaaagaatgaaagagctaaaggggttttctttattaagtcagcctaggtaactcaaatattctccttcattctcctttccagctttctgttgattttattgcgattaaaacaccatcaaatgaaaagatgaatttactgttaaaacttaaagtttcttatgtacagtccagctattgcattaccaaaagatgccaaaggaaaatgaagtgttctctctatatggagattgaatttaaaaattcatcttattttttaaatgcctggcacattagcctacacatacttttaaactgtgttccctcttcaccagctctactcttactgtttcgattcaagtcctggaatggagaggattactttcttctggatgtatccctgcctcctccctcaccctcatcaaattcaccctccactctgccaccacagagatgcttcaaaaagtacattagatcatgtcatctgttgaaattctgaggtttctctttgtcaggccatctaaggcttgtgaagacctggccttgccttagttctcaccatttttcctcttgcagccctgtccccagtacatacagtcaggccagactgcgtcctgtcccctgaacctatgatactctgctgggctttcatttcctctcctgaatgttctcgctttttgctcccaggctgtttcctattcaacctctcattctcagttcaggcctcacctctgtagagatgctttcttggccccctctcatgtgccacagcctcttgtgattcttctttcatagatcttgccccactatactgtgatagtgacttcctgcctctccatctaggcagtgagctccatgaggatcacttgctatgtctttttttggtctgtctttcaatatttcccagaacaggaccatgaactggggaggtgttgattatgtctttgttaaaataacatccaatctatattgcttaaaagtagctcacacaggccaggtgcggtggctcacgcctgtaatcgcagcactttgggaggccaaggtgggcggatcacgaggtcaggagatcaagaccatctggctaacacagtgaaaccccgtctctactaaaaatacaaaaaaaattagccaggcgtgctggcaggcgcctgtagtcccagctactggggaggctgaggcagaagaatggcacaaacccaggaggcggaactttcagtgagccaagatggcgccactgcactccagcctgggcaacagagtgagactctgtctcaaaaaaaaaaaaaaaaagtagctcacatattttacacccccactcatttctcttttaaattaattatcctttttctatacctgcttcaaaacaaataatacagtacccaaagccattcaacaggcttgagcacaagaccataaacaaatcagtttagttcactaaacactcttcattttctaatacacagcagatatttctgatttcagttgcagagctattctgattggctcattttagtagttatgtttgatcaaattgattagaggaaaccacactccatgaaggggtgatcagaaaaattggtgcttgttggtctctgatgaaaaatggacaagcctatttagcatatcacctaaagctacctcaggaatgttttggaaaactgttctgcagctgagtctgcagtcagggtccacagcctagagaggaaatcacatacttggaggcggtgctctaaagaagtgttactgatggtgatgaaaatgtgcaccgaaagagatcaatgaaacaggagctgtttgacccattgcatgaactgcactccacgttaggtttccgttgtgtacactcctcattgtattcaccatctattcccactctccaggatatacgcactcacacagacaaaacagacacacaaacacacacactccagcaagatttaggtaggaagtaacccagccaggagagatagacacagtgagatctagagattctatttttataaaggccttgcaacttgcaatcagaaatgatgtcagggaaagtggcgattgctgtttgattgggtgaatctaccattaattagtaagaaaagcactgttggtattttgaacaaaagttattattatgattaggacagttgcctcatttgtcaggaaattcaaactgtaatttttagcggtgatttaaggttaacaggtgaagaagctatgctcccaagttcaattaaagaaaagataactaaggatttacgtatgttactatatatgtctttcccgtcaggctctaaattccttgaaggcagatatgaaagtacagctactgcactgatggtgaccaaaattccatgcctcttgtacatgactatgtctagactggggcatttcttatcatagaaaaatatgagcctggctcaaatattgttttatttttacttgaagtgcaatctcttttggagtggatctgtttagattatttccaagggtttttttgaagagtcataaaggatgcacttgaaggctgtctgatcattccttgacatgggcagaattatggggagcatttgatgaactgagtacccagctaagtcaggcagctgtgggcagtggaaaagaatgatggatgtgagctgggctgggaggcagggaatgggaagcagtcagaggagggaggggctttcttatgctttatttcaccaaatcctcacaagaaacttgcaatggaaattgtattgttcccttttatatgtgaaaaaacggaggctcctggagactgagagatttgtttgcataggcgatgcatggaagaggcagggtctaaacccaggtagtttgaagcagtgctcttctttacatgctacaatacatagccttacccacagcagacttggaagtcactgtgcttgaattttctttggctttgacagtgtgtggcattgggcaaatcacttaatgtctcaggatttgtttcctcagcacccagcacaacaatgccttccctgtgttcattacagtagtgttgcagtggcctaacaaaatagcacaagtcagaaatcactttgtatttgtaaattacaaaacatgaaatgaatataaagggttattattatacttacggccctcagcctacacctgaagaaagagcaaagcaatttgagagacactgctagtgtggagtatgaacttgcatttgcaatttcataaagacttttttttttttttttgctgcaagggtctattgattataactgccagtcttcagtgcactgcttatcttacatacaattaattattccataaatcaaataagcgagttgttggcaaatgacatctgcaatctttgagctgacagcaaaatatattatgaaccataaatatctcaggccaacttttcttttctagacattttggtgctgctacccaggaagagattattaccgtgaaaaaacacttgtgcttgctgatgataacagaacatgttcagccctctcagcaaccgagggggcagctctttaatttctgatctcaggtcagcaggctcatttgacaagaccaaagtgggataatagagacatcatcaaaataatttgtcaggcctgctaacatactttgttctgagaactctggtctctgaatactacttttctgatcttatgtgaccctaattcctgcctttgctaacacacctggaatagtgcctggcacatagtagatactcaacaaatgtctacctcaaactccagtcttagactatttactttctatttcctcagcactgttgtctgattgtttcttctcctgaacatcacttgattaatctctagcatcttatactgtgtgcagaccctgctgtgttcttctgggttgagtcttagcctaaggccttggttgtcttatcggcttccagtcagctcacaactgaccagttacagttttgcacatgttcctggccctctactgctctctaccctcctgtgaaagcattggcctacccagggggaagggtgacgctttgcatagcaattgtagttgggtgatttttatttatttatttatttatttatttatttatttttttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtcccgcagtgtttgtgagattagggagtggtgatgactcttaatgagcatgctgccttcaagcatctgtttaacaaagcacatcttgcactgcccttaatccatttaaccctgagtggacacagcacatgtttcagagagcacagggttgggggtaagatcacagatcaacaggatcccaaggcagaaacatttttcttagtacagaacaaaatgaaaagtctcccatgtctacctctttctacacagacacggcaaccatccgatttctcaatcttttctccacctttcccccctttctattccacaaaactgccattgtcatcatggcccgttctcaatgagctgttgggtacacctcccagacggggtggtggccgggcagaggggctcctcacttcccagtaggggcggccgggcagaggcgcccctcaccttccggacggggcggctggcccggcggggggctgacccccccacctccctcccggatggggcggctggccgggcggggggctgacccccacacctccctcctggacggggtggctgccgggcggagacgctccttacttcccagacggggtggctgctgggcggaggggctcctcacttctcagacagggcggttgccaggcagagggtctcctcacttctcagacggggcggccgggcagagacgctcctcacatcccggacggggcgacagggcagaggcactccccacatctcagacgatgggtggccgggcagagacgctcctcacttcctagatgggatggcggcggggaagaggcgctcctcacttcctagatgggatggcggctgggcagagacgctcctcactttccagactgggcagccaggcagaggggctcctcacatcccagacgatgggcggccaggcagagacactcctcacttcccagacggggtggcggccgggcagaggctgcaatctcggcactttgggaggccaaggcaggctgctgagaggtggatgttgtagcgagccgagatcacaccactgcactccagcctgggcaccattgagcactgagtgaaggagactccgtctgcaatcccggcacctcgggaggccgaggctggcggatcactcgtggttaggagctggagaccagcccggccaacacagcgaaaccccgtctccacccaaaaaatatgaaaaccagtcaggcgtggcggcacgcgcctgcaatcgcaggcactcggcaggctgaggcaggagaatcaggcagggaggttgcagtgagctgagatggcagcagtacagtccagcttcggctcggcatcagagggagaccgtggaaagaggggagagggagagggagagggagagggagagggagagggagagcgggtgattttgacagaatacagtcactcctggtggcttgatttaatgtattttaacataatccacaaaatatgtttttcaatttttcaacagggttacacttcttaaggaaatttgcaatgtaatctactcatgacctaaagagatataagtagttttcagttatttaacttagtaaattgtctgtatattggtagattataaaatatctctttcagtcttttaccattctagtattcctttgctcttttttctttacacattatgccaattacaatggaaatatcaatttatttcaacttatcaatgtttctttaaaacatcaaactgctctgtatgcccgtgcataccagcataaaaaggccataccatcacaatctgtcatgaaatgtgtactgtattccgttgattctaacatgcacatcttttaacatgttaatatctctaaaattggctgcattttacaattgaaggcatcttagtactatttcaggattgaatggaccgtaatttttgtctcttaggactatataaaatagtggcatattatgcaaccaaaggtaccttagaattgatgaaaaccagtctaaatctaatcatagctaaaagttttaattcatgtttggcagatattgtatggtgtctcattcagtctccctccattctccttttgctgtgcttctctgtactgtggaaattccaatgcttaaaattttttaattttcaatgtagctagagttctaactaagaatggggtttagccaaatagatgagcacgcaaaacttggaatgtggaaatgagacaaagagtgtcttcctgtcatttttgggtgtgtgctactggcaatcgggattctgaagacagtatgttcctctgcaagaacattccagtatcctttttccagcttcctgtgtcctagaggcagctatggaaatggcagcagcaagtggaatttcagcttcctgatctctggagcactgttctggggtgtgctttcccactcaatagttccaatggtggtatcaaagtagtgactttgtgttgctttagaaaaaattcctggaggcccagcccataatcaactcttctagcctttccaacaatttcataaacactgaattccctttattgaatcccttgctgcttagaatacctagagtagttttggttttctttactggtgtatttgacaattacatcagattattatatgtaccctaacacaaataaatctatcagagaaataagaggacctttacctgttttctttacatcgactgtagttatttatttatttttttgagacggagtctcgctctctctccaggctggtgtgcagtggtgcaatctcgcctcactgcaatctccacctcccgggttcaagtgattctcctgcctcagtctcccaagtagctggaactacaggcacgcaccaccacacccagctaatttttttgtatttttagtagagatggggtttcaccctgttggccgggatggtcttgatctcttgacctcatgatccacccgccttggcctcccaaagtgtgatatacaagcatcaaggtttgtcatcgtgattaaagtaaatgcaatgcaaacaatttccttcagaaaaacaacagcacttagaatttctatagcctcatcatacgactataaaaataaacattattgttttaataacatctttaagttctttaaggtcaagaaggataagcaaacaaatagatggacacataaataaatcattgtttatgaaaaaagaattcacaaaatattttcacatttatctctccatttgtcacttggagaactggagtttgaaaaaaaaagcaaaaaaaaacactatatgggatatcaacatgaaccatctgtctgaccttaaataagtcatttcattttgctgtgactcagatcctttttctataaaatatggaaaataagacctgtcaatcgcctggatttcaaagatattgtcaagaaaaatattacataatgcccttgcatatgcttgagaaagaacttggaagttttggatattattaaacttggattgtgtacttttagtattattgttaatacttcataaagtgtcacaaaaatttgaaattaaccatatataggaaattgatctaattaaatagaacacatctacctcattttctttctcaaaattatagtttcaatctgcactgtgaaagagctctgtccatagatgtgataatgaattatattccaaggttaaaccaggacttctctgaaagccattagggatcagtttgatgctaaaaataatccactaataaatgttcctcattttaagttcccttctcagaaataattaaagggtacatctcagaggccagtaattttcaggctaactgccactttttaatctaagtttttctttttttttttgtttaaatttatgatacttaagccacacatcaacgtattcagtgaaaacacttctttaggatatgtcagttatgctgaacaaagagagaagaattaattacatatctttgccttagaataagattttcatttctattaattcttatacataaaatcaaactgatgcctcttgcaagcatcttttgtatgatttttcattggtttaagcagagttagatgtcagagttcattttaatttaaaaaaatttaagctttaggatttgacaaatgtatttctttcagtatgcagctgtggaagacactgaaatatgtgagctattatatctattttaagtagcaagaatagaaatttcaaaataattacatttctatagctaatgcttgaagatagtttaatgtggtggttggatgcacaaactctggagatgacttcatgaacttaaattctgtatttctccatttgtaaaaggagacaatgataatatttgcttttcaaggttttcataagcataagcattaaatgaattaatacacttaacaagggtctttttttttttttttttttgagacagggtctatcgccctggttggagtgcagcagtgtaatcatagctcactgctgccatgaacttctgggctcaagcgatcctcccacctcagcctccctgtgtgctgggattaaaagtgtgagccaccgtgcctcatcgtaagggtcttaaaagaaaccctatttcatgtaagtgctcactaaacagttaccacttactgtgacaagatacaatattgtctctttttttgtccacagggcctgtcatatttagaaacgtgacttctggtatgtccagggccaaataaaaatgttttcttacacttcacacataatacattatattaaatggcagaaatcaaaacaataggaaataatcacaaattagtgagctcagggattggacttgtctttaatttcaaatatgtgccatgattttctatgtaattagagtacatgaaaagagaataaaccaaatctagacatctctaattctaatattacaaacaaaacatatttgaaaacattcaaccacttgattgtattcctcagctttcctaaaatggttactaaattgcagacttggatgaagcatttgcccccaaatgtgtgtctgttaaactttagtttcttaggatgctcaatgaaaataaaaacagagtaccatagtcaaataagttaaataaattgagaaaaattgcatagtatattctttcttgtaaattcacattgttcattagcatattatagtcttaaaataaagaaactaatttgattatgtttaaccaacttctccaaaatatttgattataagatcaaatttgtcctcatttgtgggatattctacagaactgatgatccaaaggatgtacatttgaaaatgacagcataaaaatgaaaatgaggtctctaagtatgcttatttatgcaaaaattatactaactaaatatcaaactattgttttcatttattcagactttcttgatgcacttgatatggattatataaatctatggacaaaaatgacatcagtacaatggaatattggagttttctaccataatctctgcatagtgcactgattttgacaatcacctatggatgaaaatacatttgccagagtctaggagttaaatggaaaagttaacagcacaccgttggagaaaaatatctgggagtagatgcattcaagggagtaagaagaacaattacctgcatcacctcacccccagggtccacttcttagtgccaagatagactcccttcagcaggcaatttctcccatggggaaaaggagagtataatgagtgagtatccagcttttccagctgtgtgaggcacatcccaagaagcccatctttctttcactcaactcagaatattgagggtattagcatggctaagtggctgggacagggcagtagcaggaaagaaaggagaggactcacagcaaccaggacttgaaactcagtacagggtacatatcctttgaagcatttcacagagcccatcaggaggcccacccatgaaccacttgggacaccatatctgtagcatctccctgcaactggcccataggagcccccgatgttttgtgcatattccccttccctttctcctatagtcagttgcctgcacatgcactccagatggtgagtgtgagcatttacctacagcttttgagtacatgcagtcagcaggctcaactttgaaggattgggaggaatacaaaattgagcatttcagggcactgtcctagaggaaacaaacagaaagctttcaggacccagtttggttttgtggatttaagagaagacacacaatcatcagaatttcttctccacccatccaagaagtgtggattgggtgaatccatagaaaagatctgagagagcctcagattccctataggctcactgttgaagatatttctctcaaatccagtcagtaaagactagagaaagtgactctttcttcaaatgtgaagacagcagtgcaagactttgaggaacatgaaaaatcaaggacacctagtaccaccaaaggaacataattttctggtacccaaccacaaagaaatggagatacacaaattgtctgacaaagaattcacaacaattgttttaaggaagtcagtaagctacaagagaacacagagaacttaatgatattaagaaagcgacacatgaacaaaataagatgttcaacaaaaagatagaaattattaaaaacaaccatgattttcgagctgagaatacaatgaatgaaatggaaaacacaatagagtttcaatagcagacttgatcaagcagaagaaagggtctgtcaactcaaatactagtcatttgaaattattcagtaaaagaaataaaaaggaatgaaaaatgcttatgcgattgatgcaacaccatgaagagtagtcatatatgcactatgggagtctcagaaaaagaaagagataaaggggaagaaaactaacttaaagaactagatcagtctctccttatctgtagttttgctttccttggtttcaggtacagtacaatgatatgttttaagagacagacaatgaaagagaacatgcaaatattgacataatttttattacagtatattgtcatagtttttctattttgttattagttgttattctcttactgtgcctaatttatacattaaactttatcataggaatagtggtggtggcctgtctggagtggccactgccaggatgccagctgcagcaggggaggtgtagctggggctgtgcactccgcagagctggggggggccaggaacaggtgatcctagtgggagccctatatgctactgagttagtggggtgggagcctgtgctcccaggcatagctgcagctgcccagccatggctccagccctaggcatacctgtgctctcaggggccctggaagtcccctgcccttacaggcttggaagtgcctgctcccattccctggcctctttccactgctggcacctgctctgtggcagagcaaagttgtggatgtgttgtgatagctgagcctgggagctgttgtgacgtggtcaggtgtgtgtgttcagggcagttctgatacaccagactccccactgcctttgccccctctggaaactgcttctgaggctgaaactttggatattaatgagcaaggatggtgggggaggccaggacggctgagggcagctaggtgtgggcctgtggacaccccttagtgcggacagtctgggtgctgtggatggcatgttgatggcagcgagaggcagacatgttcctaggtgggaacgggtgggtccctggtgaaacctcaccttcaagccagggacagcttgaagcatgggggcctggctgccagttccggttgcagtctgtgacctggagtgaaaacttcattgatgtctttcagccaattggatggtgctttttccagacccacaaatggctgcccatggaccaagcagtatgtacttcctccattctgagcccatgaaaaccccagactcagtcagactctgacactcatcaggatgacaagcctgcaaataggatctacccattttgggtatgcactccactgagagctattctgtcactcaataaagctcctttctgccttgctcaccctccagttattcacataacctcattcttcctggatgtgggacaagaactcaggacctgctgaatggtgggagggaaagaagctgtaacatgttcctggccagctcaccaagctgcaggtggtgacatactcctggactatgggagtgaagagtagtgacccttctgggggcccagaccttgagattctccgagccagagctgcagtaacactatagctctcctgccctctgctggtgctgggtggccccccaatgcaacaggacgcagcagcaggcctgggccagcccaggagctgggagcctgagtggggtggtggaactgaaagggctataacacaaaccaaccaaaacatgccccactcacttgctgcactgtgggtgaggagaaggagaaaagagctgcagcccttctaggaagccagactttggggctccctgaactagggctgtgacatgctgtaacaccttctttaggattctgcacttcctggcctctctgagattttggatgccaccgtgttccctttgtccagatgctggtgtccgcagcagaagccacttgtgatatatctggtccagctgcagcttcacatggatgaggtgcctgtgccggtgcctgtgccagtgcctggagctgcccgccccaccacagcagctagcatgcctggctgtgtgcagtgccagatcccacacttgctcactcacacacacctcaccgctccatgcctggcttgcccttggaaggagtacgatccaggccggtagcatgagccaagtgcagcctgccagcctgagtggacagaacaagcccagggggcatgaacaaaactcaagcagaagcactgctgtccacagaggtttctggctggcaaagcaacaccctaaggatcctatgacaataggtatatatgtataggcagaaacatagtatatattggttttagtactatccatggtttcaggcagccaccaggggcttggaatgtgtccctgtagataagggaggaggattttaatagctgaaaacttctccaatcttggggaagataggggcatttgggtacatgaggcttaaatgtgcccaaataggtttgacttaaagaggacttcactgagacacattataatcaaattgtcaaacatcaaagataattttgaaagcagtaagagaaaagaaactcatcacatacaaagaaaccccattagactatcagatttctaagcatgaatcttgcaggccaggagagagcgagatgacatatttcaagtgctgaaagaagaaagaattgtcaaccaagaatactttaccttgcaaaactatcttccagaaatgaaggagagataaagactttgccagataaagaaaatatgagggattttatcaccactacatatgccttataaaaaatgttagagggagttcttcaaatggaaaagtaaggattctaattagtaacatgaaaacatatgaaagtgcaaaactcactggtaaaggtagcatatattgtcaagttcagaatactctaatgctgtaatggtggtgtataaaccacttttactctaggatagaggtgaaaagacaaaattattaaaaataatcacaatatgctggtgcggtggctcacacctgtaatcccaacactttgggaggctgaggcaggcaaatcatgaggtcagaagtttgagaccagtctggccaacataatgaaaccccatctctattaaaaatacaaaaaattagctggatgtggtggtgtgtggctgtaatcccagctacttgggaggctgaggcaggagaatggcatgaacctgggaggcggaggttgcggtgaactaagatcaccccattgcactccagcctgggcaacagtgcaagactccatctcaaaaaaaaattcactataataattcgttaatgaatatacaatattaaaaaagtaaattatgatatccaaaacttaaaatgtggaataggggagtaaacatgtaaagtatatgcaatcaaagttgaaatcagtttaaaatagactgttataaatataagatattttctgtaagccccatggtagccacaaagtaaaaactttagtagatacagaataattaaagataaagataataaattaaagcatgccactgcagaaaatcatgaaattacaaaggaagagcaagagaggaaaaaaggaacaaaataactacagaagagaaaacaattaccaaagtggcaataataaatcctaacgtatcaataattactttataaatgaactaaattctgtaatcaaaagacctacaatggcaaaatggataaaaacaaacaagtaagattcaataatatgatgtctacaagagacttgttttagctttgaggacacacataggctaaaagtgaagagatggaaaaaatatattccatgcaaatggaaactaaaaaagagcaggatgagtatctgctatttatataacataaaatagattttaagtcaaaaactgtgcaaagagacaaagatatttataatataatacataatatctctataagcttataatcatatataatgtatattatgttatataatgtatatccttatatctaatatatatccttatatctttatatttattattatatatgccatatataactgtaaatatatgatatatataattataaatatctttgtctctttttgcagttcgacttaaagtctattttatcttatgtaaataacggatgtgtttatcttattatatatttatataataagaaaggggttaattcatgaaaaggatataacaattgtaaatatataggcatccaacatcacagcacctaaatatatcaatcaaatataaactagtctgaagggataaatagataatacaataatagtatttcaagataatatgcatggtagaccacatataatctattgaaattgtaaaaaataaagaaaaacacaagaggacttcctcatagttacacattggtgaaaagaaagtgttctagttaccactcttgtacatttggtggatattctcaatgtcctgcactatgctaggtcttaaagaagtataagacttgcacatgtatcttgaaagagtagctcattgcccagcatagaaagaaagaggagtagaaaatttcaggcatggataaaggtgcagaggtgcaaatatatatacactactcaatagtaggtaagggagtaatggcaactaacgttaaggaacattgtctaccgtattgtgaagggtgacaaaggtcatgcgtactaatatgatgattaactgtctatagcaaggctatgagtaaaatttaaattatatgcagcctaggtattgaaatttgacaaccaatataaatgaattcatatgtttatgaaacattctttatttctttttatcaatgacctagtagattcagaatcaatttttcagtgcttttcaagataattttgatacgattggaaataaatagttctaaatattaaaagaaaacctgaatttttgcaatgtcctttctaaatttataaacacaaaattttcatactgcagagatacttgggaaaaaaaatatttgttgtttatatatactcacccagaatctacacaattacaaatttccttaagtttctgacagcaaaaaagaacatgaataactaaatacagagaatcataattggaacatattcaagaggtggagaatctatttaaaaccgacaactcaacagatgtagtctagtcaatggttatatttgcataagcatgaaagccaaacaaacatgtctgaaatctcattggtaaaacactgtatgatttaaaaaattttgggggggttgtcagaactcctttttagatttattgcatcccctcaacagaagaaccgactgccgagaaattcaaaacacatccgtgaaagcagaaaattataatgtgacaagtgaagaattgaaatggattcaccctaaaagcagagccaaatatcagccattgtcatgggcccctaggaggactgagtctggtgatgcacgaataccagaatgcaagtgtggtgcaatgacagcaataacacatgtgtgcaccttgaagccagagggatggaaaccccagccaatgtctctttctcttttcagccatgtaaattccaatcttgatcaataagcaatccaggtgtcaatgaaagtggaaggaatacatattcctcctcccacaaatcttaaacattaatagcagcaggattctcctttcacagaaaagcatgattttaaggttttggtccccactgaacacaaattcccaagatacaaataaaagtactttgatttatagattaatccagacatttttatgttctgtaggcctgacatatgcttgacagaaaccccacaaggtcagaaagtcctgttgtctaagaaagaatttctcttctgctttcttgctcattttggcctgagaggaaggtgatactacagttagttgtggtcttaataaagagcattgaagtcagaattcataaatttaggcttttttctttctcaggaattattgaaaagaatggcttacaattttttaaaatttattttgggagagataatcatattatttagggagagagatagttatattatttttctgaatctctcaagcttcacataacagtgaaagattcatgaaccactgatttaaaaaaggtacaaaagcaacagtttttaaaccacctgctatatactcatttgacaatattaaggggcaatgcttctggtgttttcaaagaaattggagtagtgggcaggagagctataattaaggaggagcactgcactgggattggaccaaggttttatattaagaacaacattctgttttatcctaactagtgtaacttattcattccacaaacatgtattgaataacttctgaaaataaggctctttttgccttcaataagatctctgcatgtaaaagaaaaatactagtactagttatacaaaaactttgaaataatatatcagcaggaggcaaaatcaaaacaaaataaggcctggtgtggtggctcatgcactttgggagactgaggtgggagaattgccttagaccaggagtttgaaaccagcctgggcaacatagagaccttgtctctacaaaaaataaatacactagcagggtgtggtggtggatgcctgtagtcctagctacttggaaggctgaggtgggaggatcacttgagcccagaaggtagaggctgcagtgaactatgatcatgcctttgcactcaagcctgggcaacagagcaaaaccctatctttaagcaaacaaacaaaccaacaaaacaacaggacccctgtcgtatctctccccatgaataatataacaggcaatttcttgaatattaaaactggtattccttatagattattacagtggcctcactttaaacagaagaacctgaagcccaaaaaggtgaggtcactgctttaaattaatagttagaaagctgcagaatcaaacagactcagttctctagattcctagcccagttacatttttttagtatgacactatcacccttaacaacaaccaacaaaacccaaactgcttaaaacattttaatccaaggcaaatctttagttcttctggtttgctggagtgggaggtggggtggagggactggggaaacagtaggatgaggcagtggagatttaacattcttgtatgtgctggagtgctgtgctaggtgcttccatttttaatctctttaaatgcaagaactttgtgagatcagtgctattccctccattttccaggtgaggaaccatgagtctcagagaagctaagaagtttatccagacacccacatttttgtgagtggtggacttaagatttgaacctgttttggtttccaagttctttggtctttttactgttccttaattgttgcctgttacaggatgccttgcatttcttcataaatgagtccaatttttgcctgccacctggtttatatgactgtccagattgatttttcttttaaatttacattttgcaactgtaggcttttttcctttccatttacctcctgcctcagtcatgaggttggaaaaaatgagaagtatgctggttttgtttggactgagaacattccaaaatgtttggctgcacctcaaaaccctgttaaaataatattatttataactttctgcttggtcaattttgttttaagtttggctatctcccataggaggttattctttctccttgatggtaaggtttgctgcttgaaagccttaatcttaaacatttttcaagtaagactcaggtccttgcctgaatacaaactcgttagataatagccccaaccactctgaagcagttcattgcagaagctcactctcagctgttgtgggtggggtgttagcagaatgaatgccataggtttacatgtgaaccatcagccctgctcacaaaatataatctgtccagcaccgcgataggttgcattttagagctgggctttagtatggtgtgactgtttaccagaatgccttctgaggaatacaaagtaatttttttttttttacattcctcctcagtaaggttattgttgttagcagatttatttagctgccctagcagcttaagacatttcattgacttttgagcagacgatttgatttttcaggcacagatgggggaaaaacagctagcagaatcattagaatggatacctaccacaagtagtagggaggcaggcttttaacaggacatagctaaagagaagacctgtctttgcctcaatgtgtaattgaacactgtctaaaattgatggcaaagcaatgtgaattataggggccaaggatttgctatttagaaacttaaacaaatctgctttttctaaaaggcctttctttttcacacaaaaacgatggtcagtgaagtggcaattctcagtgaaacgacaatgcttctccctcaggagcagctaccctcaaggaaacagagccaaaacacagagactgaatcattaacctaaaaatgtagttacataactgctaaaattccacactttgcaggcctgtggcctgactttagcctttagagacattcctagcccagtggttgctagtagccactgctcacatttctccatctctctgcctcccaggagctaaactcctattgattttcccagaaccctgagctgtctccataatagaatgatttggtgggcgtcctgtcaaatgcaaaaggaagcctctgccagactgagcattagaacacggtgtttttaaatagaaatgtgaaatatcagtgcaattacaaatcaataaaaacccagagggaaagagaatctcatttgaggaaagatctttaagtttttttcctttcttttttctcgtaatgaaaaattagatcagggaaccaaatttatgaggtaaaaactgtcaacaaagtattcctagctgttgctgaggctgagaaaaaagaaagctaaatcatgcatgcagtgtgagtatgtgaatgacacattttaatatattagggagtcaaaatacctctcattttttacttgtgtttttggctgttgcccaaatcgttattgttttatttattttgctaatgtcattctcttatgcctttttccaaattccatattttctcctaggtttgctttccatatgctggatgatgtgtgtggattttcagtgtgtgtttcagagtcttaaaagctcatgctagcttgcttaacatacctgccataactcatgatatagaaccctatggagaactgtgttgcaacatggatgcagtgcctatactaaggcacattgccaagctgaagactgtcagagagcatcactaacggaggtaagccagtagggtctaaaaatcttcacagagagaaggtatgaccagatgatagtccattaaattgcgttgaggtgcagcactatgttctaaattggtgtaccccacgaatttatatgttgaggcctaatacccaatgtgatagtattaagaggtatggcctttaggaagtgattaagtcataaggtgagggcttgacccttatgaatgagaatagtgaccttataaaagaggcttgagtgagctctctggctcttttttgccatgtaaggatgcagcaacaagtcaccatctattaagccaattaccagacaccaaatctactggtgctttgatgttggacttcccagcctccagacctctaagaaataaatctctgttgtttataaattactgagtctaaagtactttgttatagcagcctgaatagactaagacatgcagcaagtgaatagatcactcactgtagcctggatctctccttcattatgacagggttgtttctcgtactggacataggtcacctttgctaacctcttacagaaattctaaactttgtgagaggaaatgcagaaatgtgagagaagaacaaggagctatgtgaagaagagagatggaaatggattgagactgttgaaataggagaaaatatcttggttttgacatcatttccaaagaatcatagttatcaaataaaaaatttcacaattatccaaaattataataaaaattcagtggctggcaaaatggctgaataggatcagctctggtgtgcagctcccagtgagatccacacagaagatgagtaatttctgcatttccaactgaggtacttggctcatctcattgggactggctagacagtgagtgaaacccatggagggcaagctgaagcagggtgggacattgccttacctgggaagtgcaaggggtcagggaactccctcccctagccaagggaagccatgaaggactctgacatgaagactggtgcactccagcccagatactacgcttttcccatggtctatgcaacccacagaccaggagattccctcgggtgcctatgccaccagggccctgagtttcataaaactgggcagccatcccgagctagctgcaggaatttcttttcataccccagtggtaccaggaacatttaagtctgctgaagctgcgcccacagctgccccttcccccaagtgatctgtcccagggagatgggagatttatctgtaagcccctgattggggctgctgcctttctttcagagatgccctgcccagagaggagtctagagaggcaatctggctacagcagttttgaggcgctgcagtggtatccacccagtctgaacttccaagcagttttgtttacactgtgaggggaaaactgcctactcaagcctcagtaatggcaaatgctcctcctggcagcaagtttgagcatcccaggtcgacttcagactgctgtgctggcagcgagaatttcaagccagtggatataagcttgccagtgagatagaaccgttcagtcccctggaaagggggctcaagctagggagccaagtggcctagctcagcggatcccactcccatggatcccagcaagctaagatccactggcttgaaattcttgctgccagcacagcagtctgaagttgacctgggatgctcaagcttgctgtggggaggaccatttgccattactgaggcttgagtaggtggttttcccctcacagtgtaaacaaaactgctaggaagtttggactgggtggagcccaccgcagcgcctcaaagctgctgtagcccgactgcctctctagactcctcactggcagggcatctctgaaaggaaggcagcagccccagtcaggggcttttagataaaactcccatctctctgggacagagcacctgggggaaggggcggctgtgggctcagcttcagcagacttaaacgttcctgcttggtggctcttaagagaggagtggatctctcagcacagcgctccagctttgctaagggatagactgcctcctcaagtgggtccctgacccccacgcctcctgactgggagacacctcccagcaggagttgacagacacctcatacaggagagctccagctggcatctggcaggggcccctctgggatgaattttccagaggaaggaacaggcagcaatctttgctgttttgtagcctctgctggtgatacccaggcaaacaggagccagagtggacctccaggaatctccagaagacctgcagcagagaggcccgactgttagaaggaaaaataacaaacagaaaggaatagcatcaacattaacaaaaaaggatgtccacacagaaaccccatccaaaagtcaccaacatcaaagaccaaaggtagataaatccacgaagatgaggaaaaaccagtgtaaaaaggctgaaaattccgaaaaccagaacgtcttttctcttccaaaggatcacaacttcttgccagcaagggaacaaaactggatggagaatgattttggctaacagacagaagtaggtttcagaaggtgggtaataacaaactcctctgagctaatggagcatgttctaatccaatggaaaaaagctatgaaccttgataaaaggttagaggaattgttaactagaataaccagtttagagaagaacataaatgacctgatggagctgaaaaacacagcatgagaacttcgtgaagcatatacaagtattaatagctgaatcgatcgagcggaagaaaggatatcagaattgaagatcaacttaatgaaataaaacatgaagccaagattagagaaaaaagaatgaaaaggaacaaacaaagctacaagaaatatgggactatgtgaaaagaccaaacctgtttgattggtgtgcctgaaagtgacagggagaatgaaaccaaattggaaaacactcttcaggatattatccaggagaagttccccagtctagcaagatgggccaacattcaaattcaggaaatacagagaacaccacaaagatactcttcgagaagagcaaccccaagacacataatcgtcagattcaccaaggttaaaatggaggaaaacatgttaaaggcagccaaaataaaggtctggttacccacaaagggaagcccatcaaactaacagtggatctcttggcagaaaccctacaagccagaagagagtgggggccaatattcaacattctcaaagaaaaggatgttcaacccagaattttttatccagtcaaactaagcttcataaatgaaggagaaataaaaccctttacagacaagcaaatgctgagagattttgtcaccagatgtgccttacaggagctcttgaaggaagcactaaatatggaaaggaaaaaccagtactagccactgcacaaacataccaaattgtaaagacaatcgacactgaagaaactgcatcaactaacgggtaaaataaccagctagcatcataatgacagcatcagattcacacataatcatattaaccttaaatgtaaaggggctaaatgccccaattaaaagacacagatggcaaattggatagaaccaagagccatcagtatgctgtattcaggagacccatctcatgtgcaaagacacaaataggcccaaaataaagggatggaggaatatttaaacaaaacaaatggaaagcaaaaaacaaaaagaaaacaaaaaagcaggggttgcaattctagtctctggtaaaacagactttaaaccaacaaagatcaaaaaagaaaaagaagggcattatgtaatagtaaagggatcaatgcaacaagaagagctaactatcctaaatatatatgcatccaatacagaagaatccagattcataaagcaagttcttagagacctacaaagagacttagagtcccacacaataatagtgggagacctaacaccccactgtcaatgttagacagatcaacaagacagaaaattaataaggatattcaggacttgaactcaactctggatcaagcagaagtaatagatatctacagaactctccaccccaaatcaacagaatatacattcttctctgcaccacatagcacttactctaaaattgaccacatatttggaagtaaaatattcctcagcaaatgcaaaagaactaaatgataacacagtctctcagaccacagtgcaatctaattagaactcaggattaagaaactcactcaaaactgcacaactacatggaaactgaacaactgctcctgaatgactactgggttaataatgaaattaaggcagaaataaataacagttctttgaaaccaataagaacaaagacacaatgatgcagaatgtttgggacacagctaaagcagtgtttagagagaaatttatagcactaaatgggaaagatctaaagttgacaccctaacatcacaattacaagaactagagaaacaagagcaaacaaattcaaaagctagcagaagacaagaaataactaagatgagagcagaactgaaggagatagagacacgaaaaacttcaaaaatcaatgaatccaagaggtgttttttttaaagattaacaaaatagatagactgctagccagactaataaagaagaaaagagagaagaatcaaatagatgcaataaaaaatgataaaggggatatcaccactgatcccacagaaatacaaactactatcagagaatactataaatacctctacacaaataaactagaaaatctagaagaaatggataaattcctggacacatacaccctcccaagactaaaccaggaagaagtcgaatccctgaatagaccaataacaagttctgaaacagaggtagtaattaatagccttccaaccaaaataaatcccaggaccagaaggattcagagccgaattctaccagagatacaaagaggagctggtaccattccttctgaaactattccaaacaacagaaaaagacgactcatccctaactcattttatgaggccatcatcatcctgataccaaaacctggcagagacacaacaaaacaagaaaatttcaagccaatatccctgatgaacatcaatgagaaaatcctcaataaaatactggcaaaccgaatccagcagcatatcaaaaagcttatccaccatgatcaagtcggcttcatccctgagatgtgagagtgtttcaacatactcagattaataaatgtaatccatcacataaacagaagcaatgacaaaaaccacatgattatctcaataaatggagaaaaagccttcgataaaattcaacaccccttcatgctaaaaactctgaataaactcggttttgatggaatgtatctcaaaataataagagctatttatgacaaacccacagccaatatcatactgaatgggcaaaagctggaagcattccctttgaaaaccagcagaagacaaggatgccctctctcaccactcctattcaacatagtattgaaagttctggccagggcaatcaggcaagagagagaaataaaggatattcaaataggaagagaggaagtaaaattgtctctctttgcagatgccatgactgttcatttagaaaaccccattgtctcagcccaaaatctccttaagctgataagcaacttcagcaaaacttcacaaaatcaatgtgcaaaaatcacaagcattcctatacaccaataatagacaaacacagagccaaatcatgagtgaactcccattcactattgctacaaagagaataaaatatctaggaatgcaccttaccagggatgtgaaggacctcttcaaggagaactacaaaacactgctcaaggaaataagagaggacacaaacaaatggaatgttatccccatcaagctaccattgactttcttcacagaaattgaaaaaactacttcaaatttcatatggaatcaaaaaagagcctgcatagccacgacaatcctaagcaaaaagaacaaagctggaggcatcacactacctgacctgaaactatactacaaggctacagtaaccaaaacagcatggtactggtactaaaacagatatgtggaccaatggaacagagcagaggtctcagaaataacaccacacatctacaatcatatgatctttgacaaacctgacaaaagcaaactatggggaaaggatttcctatttaataattggtgttgggaaaactggctagccatatgcagaaaactgaaagtggaccccttccttacactttatacaaaaattaactcaagatggattaaagacttaaacgtaagacctaaaaccataaaccctagaagaaaacctaggcaataccattcaggacataggcacgggcaaagacttcatgactaaaacaccaaaatcaatggcaacaaaagccaaaattgacaaatggggtctaattaaactaaagagctcctgcacagcaaaagaaactatcatcagggtgaacaagcaacctacagaatgggagaaaatttttgcaatctattcatctgacaaagggctaatatccagaatctacaaaaaatttaaacagatttacaagaatgaaacaaccccatcaaaaagtgggtgaaggatattaacagacacttctcaaaagaagacatttatgtggccaacaaacatttgaaaaaaagctcatcatcactggtcattagagaaatgcaaatcaaaaccacaatgagataccatcgcactccagttagaatggcgatcattaaaaagtcaggaaacaacagatgctgcagaggatgtggagaaatagaaacacttttacactgttggtgggagtgtaattagttcaaccattgtggcagacagtgtggcgattcctcaaggatctagaaccagaaatatcatttgacccagcaatttcattactgggtatatacctaaaggattatagtcattctactataaagacccatgcgcgcgcacacacacacacacacacacacacacacacatatattttgataaaaagtaaactttaatgtcgaaaatgcaaacttggggagtgcagaagtatcacacgcaaggctgtcacttcacacttggagagtttcacagcgcccaggcagaggtgctccttacatcccagatgatgcgggggccgggcagagccgctcctcacttcccagagggtgggcgatgggcagaggtgctcctcacttcccagatggtgggcagctgggcagaagcactcctcacttcctagacagggcagtggccaggcagaggggctcctcacttcccagtcagttgggtggccagacagaggcgctcctcactttccagacagggcggcagccagagagaggtgctcctcacttgccagatggggcagcagccaggcagaggcactcctcatttgctagatggtggggccgccgggcagaggggcatttcacttcccagacagggcagcagccaggtagaggaggcacacgtatttttattgccgcactgttcacaatagcaaagacttggagccaatccaaatgccaatcaatgatagactggataaagaaaatgtggcacatatacaccatggaacactatgcagccataaaaaagcatgacttcatgtcctttgcagggacatggatgaagctggaaaccatcattctcagcaaactaacacaggaacagaaaaccaaacaccacatgttctcactcataagtgagagctgaacaatgagaacacatggatacagggagggggccatcacacactggggcctgttggtgggtagggggcgagaggagggatagcattaggagaaatacctaatgtagatgatgggttgatgggtacagcaaaccaagatgacatgtgtatacctatgtaacaaacctgcacgttctgcacatgtatcccagaacttaaattataataaactaaataaataaaaattctgatatttttaatccaagaggggtaaagatgggaaaataagaagacaaatacagtcatgctctgcataatgaggtttcattcaacaatggagcacatatacaatggtggtcccataagattacaatatcaagttggtgcaaacataattgtagtttttgcaattacttttaatagcaaaaaccacaattacattcgcatgaacctaataaaatatttttactgtaacatttctatggttagatatatttgtatacacaaatagttgccactgtgttgcaattgcctacagtattcagcacagtaacatgttgtaccaatttgtagtgtgtagtagactataccatctaggtgtgtgtaattacaatcactctatgatgtttgcacaaccgcaaaatcacctaataatgtatttctcagattgtatcacatcatgaagtaatgtatgactataatcatatatatgatggtggcaagggaacacaatcactatgtcatctccagatgctttgagccaatagtttttcttgtttctttttctatgtcaacaaaaaattgtgaagttttaaataatttctcaagattaatagtaataacatatttcacaatttattgagctgacttcatgtactttaaaaatttctctcatattttcaacaactgcaactttcggacttctagaaagctcaaagagatgaacagtccatgtactgacctgttcctgatttctacagcctcacctctgccaccacatctgcctcttacacatctctatgtttttggtttacaacttgatgtaagatggtaggtggtgggtcgagttctgggagattcctgaaaaatgtagccttaatgagagaaatcaacatatattccaaaaattaggggtttagtagtgaggaatgggtggtttcatcttcatttgcctttccttgtatattttgtacacttcttaaaactaaaattgtaatacaactgcattaagggtgattggaatttagggactgcagaggggaaaaagacagcatctggtttgatgtactgtaaatctcagggaatctaaccaatggtatgtttattaaaattataatctgtacttttcctagaagcggtagttaatgcaagaattaaacatttgtaaatattgcatagtgaattcatttttgaaaaagtttgctatgagttcttcacagaaattatatgggtatctaactcaggatgttcctgcagcctaaagcagtataccgaatcctaagtctacactaaaatttgaagtgaatgtctagatccatccttagggtaggggcaaatgtaacacaaagatggtttttatatttaaagttcaaatggaaacattacttaagaaacccaagctttgccaaagggccatttgattttcacttggctttggaaaataatataagaaacccattttcctcagaaggctgggaaggaattgaaatagaaaaccatttgcccttcaaaggaacgtatccagttgtctagatctggaaatgttagatgacaatattgctttctttgaagtgactgagtcatgtgggtcaaaattcctcatgaaaaatatgtttagacatgtcctaaattatttagaataaggctcaatacttccattactaaggaaagtatataaggggccttacacagtcaatgcatagtgcctgagtgaggtattcaccaagaacttggaaatggtatcacccttagggagttcatctaataaaatctacacatgacagatttgattaccattcactatgggtaaaccaggagatatttgtaaatgtaagactggaacatctttttaacacctaaaactccaacaagggaatgtcttagaaaagtagaatgggaagatgcttgtggtatatagtaagctaaatttgatcaatcttatgatacacttttgtagaaaggccgtgttaaaagaagagagatggttagactggaataattaaaaagaagtatcaagaactaatatttgtcagaatatcttcagcagtcccagggttcttgttagttcttcaaattccccagaccttatggcaggcaaaatctacaaagtggataaatgcatttggcctttatagctccaagacacacatcattaaggctgcctacctcaagaaagttactgattataatttagtttcccatgcatattatcttacaggaaagtaatgtctgactaactgatgcgaactttcttatcttcttagtgatggcagcagcagcccatccagaatggctgctgccaacatacgggctgcagtggggaggcacagccagtcctcccactccacagagcaggcaggagtcccgcccctgggccccaggcctcctgctccaagggacaagtgcaagccctgccccttccgaattggcagggcaggagctcctcatgggcagctgcagtcacccaagcccggctgtggacctgggcatctctgtgctcttgtggggctgggaaggcctccctacccccgactccccacagactctgaattgcctcgtcccactgtctggcctctccccactcctggcacccactcagatcatggagcaaggtgggagcctgctgagtggggcatgcttgggtcagcactgacatgtcagccccactgccaccttggccccctccagacattgggtgctgatgagcacgggggggactcaaagcagggctgaaggcagctcagtgctggcctgcaggtgccccttggtatgaatagcctgggtgccatgaacagcaggaaaggcaaacaggctcctgggctgaagagggtgggtccccagtgaagccccaccctcaagctggggaagccttgaggcctgggggcctggctgccagtcctgtggactgaagggggaagtggtggtgctttttcctgggcccacccatggctgctgatggaccagtcagcgcacactttcccacttccccacaagactgtaaaaaccccagactcagcgagagcagagcagatatctggaccagcagctacagagaggagctccctgctccagggccccctctctactgagagatgtgaacaatttgacaaccagcagcacaaaggagctaccttccctgctgagagctgaacatttgtcaggacaagctatctgcagagaggaaccacccactccaggcctcctctttgctgagagctgaacactcaacaggatgaccagctgcagagaggggccactcactccagggcttcctctctgctgagagctgcagagatgatgggattacctgcctacagagaggagccacccactccaggcctcctctctgctgagagctgaacactgacaggataacctgcctgtagagaggagctatccactatgggtctcctctgagcttttctaacactcaataaagctcctcttcatcttgctcaccctccacttgtctgcctcattcttcctggacacaggacaagaactcgggccaaggcgccattgtccgcagatatttctggccaggaaagcaacaccccaaagatcccataacattagtagatcttttcctcttagtatgttgataattgacttgctggtttctatatcaagttcttaatgatttgattaataggagccagatccccagagcttgatcccttctagatgcaatgacacactgagttctaaagttaaagtgctggtgaccccatggtgacacactttggccttcccttggtagccaaggagactgatgttaatgctatttcattttgtcctaactgagcatcaagtattctcaaattcagtaaagtggtttctaagtgaagagaatggagtttgagaaagactagggtggcgaaaaatagtgtttaataaaatcagatgctaagggaatagaaactgggataaaaaatattgggtgaaatgaaacagaaaaaggattttattatactttatagtttattgtattttattttatttttatttatctatttgagacgtagtcttgctctgttgcccaggctggagtgcagtggtgcgatcttggctcactgcaacctccacctcccaggttcaagtgattcacctgcttcagcctcctgagtagctgggattacaggtatgccccaccacacccagttaatttttgtatttttggtagagacaggtttcaccatgttggccaggctggtcttgaattcctgacctcagatgatccacctgcctcgacctttcaaaatgttgggattacagccatgagttactgcacccggcagtattccttatattttaatattacatatttataattttcaggtaatatacaatgaaaattcattgcaattagagtgttaaaataaaatagtgtatgttaagaagaaatacaatgcagatgcttttttttctccccagtccttaattatctctaaccttatatttacactggtatctctgagtgattcagatataattaacatttactgagcatacagtgtttgcaggtaatgtggtagtcattttaaacactatatatcatggaattattttgccaaaactaattgatcaattcatcaataagtatttagaatgactattttcctcttatcttgagtctgcttttaaatgacctcaaaaagactaatttaggtccccttccctcccaacctccacaaaatggaatatcaattgttattattttattagcaatgcaaaaccagtaaaaagcttgactggatttctcattctacagggggagtgagagagtgactggtgaagcatctgaatgcaaaactgaagggatccaaggaaagctcagctatggggcagttttcctatctaaaaaggactaacagttctctgttaaccttcttttgtgtcaaatacaggaaattaatgcggttttaaaaatatctcctgcaagttgatcagtgtccttttattttttgtttttctgattttatcccttcatgagtattgttcccttttgctatgcaggcaaccagcctgatgggctagttttccaggtaatccaacttggctccacggctttaagactctgttgaatcaagctggtttcttccttgcatatcttcttctgtttagaaaccttattccttgttggtgattttgtcagttttgtgcttcgattgctttgtgtcataaaacctttttagataaaactatatgtgttggggaaggagaccaacaaaaatatattattcaattaccttaatcaaatctctttgggttaatgagtgtggcctcagttatggcaatttttagaaatgtagcttttgaattgaagttcttttgaaaaaataaaactacttattaggggcaaaaaaacaaggaatagttgtgttctacttttgaaacactgtcagatttaaatagtactggtacaatagaaatcttgtggcttgggattcagagatctgagttccagttttcgctttactcgtaagtaatattaaggtgatcaggtaaactcctcttagtttctttctctaaaaagatgggattaaattagatgattttttaggatatctagaaattctaagactctgtaacacactgtgttatgacaaggtccttttagacataaatcaaaattattctgaaattatttcatattttagaggcatcagtagggcttattataaaatgaactggtatgaaatgacattattatctttatttcacatgctgtagatataaatacatactctaatgagcttcaaataacattaattaaactgtttgagaagagtcaccctctaatcttttttgaaaacaaagctgcccagtagaaatatgtgagccatacatgtaatttatattttctagtagtcacattaaaaagtaaaaaaagtaaaattaattttactatcatattttagttaatccgatacgtccaaaatattattgcttcaataggtaatcagttaaaaattaatgagttattttgcattcattttcttaataaaacaattttaaaatgtctggtgcatattttatacttacagcataccttattttggattagccacattccaagtgctctatagccacacatagctggtggctaccataagtggtcagtgctaatctagataaaatactttattccaatcataactttaaaactgtgtattaaaagtatgtgagaaaaactcttcgttctttgtattcaactgaattccaattaaccttttgagaagattgtgtttgcccaggttttgacaacgtggccactttcacacagtacaaactgcagggatgtcaatcatctttcagagaatgtaggttgtgcaacgaatcccaattatccagcatccatgacagaggctgtgatggctttgcctggaatttcaaaaatggtctcaacttaaaagtgacatatttcattgtgttcattgaaaaactgatgccttatcagaaaacctattttttttactgcctctagaatactgaccattgcaaacagatttttaaaggtttcatatatactgtggacagttctttcaaagccccaaaacagagaaaattagtccaaatttgctctttgttgcaaacattttgcacaacattgggctatgtatttgaatagtggtgttacatagtaaattagctttttgaactaaaacatttaaacaaactttctgtgcctttgttttggctccatatttatttattgaaacttattattattattttttattgataaaccataattgtctacatttatgaggtacagcatgatgttttgatatatgtatatatacaatgtggcataattaaatcaagctagttaacgtgcttatcaccttgcttacctattatctttataatacatttaaaattttctgttatttaaaaatatatattattattgactatagtcaccctgctgagaaacaactctcaaaacgtattactcttgtttatctgaaacttcgtaccctttgattacctgtcatcattccctttcttcctaaccctccctacctgccaccctagcctctgctaaccattgctctactctacttctatgaattcaatttacttttttaaattaaattaaatttaattttaacttctgggagtgttcaactttattagatttcacatacgggtgagaccatgcagtatttgtctttctgtgcttgacttatttcacttagctccatgtcctccaaattcatccgtgtcatcacaaatgacaggatttccctcctttgtaggaccgaatagtattccgtcatgtatgtgtacccacattttctttatccattcatctactgatggacatttgggttgtttccatatcttggctattgtgaacaatgctgcaattagcatagcagtgcagatatccctttgacatactgatttcagtttctttggatatatacccagaagtgagattactgggttgaatcataattctatgtttggtttttctgggaagctccataccctgttttcataaaagctgtattaatttttattctcaccaacaacatataaaagttcaatttttctgcatcctcttaatggttatctttcatctttttgataaaagccattatatcagatgtgaggtaatatttcattgtggttttaatttatatttttctaattagtgatgctaagcatttttccatgtacctattagccatttgtgtgtcttcttttgaaaaatatctgggccattttctcatttttaagttatttgttttcttgttttaagttgtttgagtttcttatgtattttgcatagtaaccccttatcagatgtataatttgcaagtattttctcctattctgtgggttgttttttcactttgttaattatttcttttgctgtgcagaatattttagttggatgccaccccatttgtctatttttatttcattgcctgtgcttcaggggtgatatccaagaaatgactgtctagaccaatgtcatgaagattttcttctttgttttcttttagtagttttacaggttcaggtgtcttctatgtaagtctttaattcattttgagttgatttttgtatgtggtataagataaaggtctaattttattcttctgcatggggatatccaattttcccaacaacaattattgaagagattgtcctttccgcattgtgtattcttggcaactttgtcaaaaatcagttagccgtcaaatgcataggtttatttctgggttttctatcttgctccattgatcaacgtatctgtttttatgcaagtaccatgcagctttgattacaatcactttataatatgttttgaaatcaaggcatgtgatacttccagctctgttatttttgctcaagattgttttggcaattcctaactcagtgccctgaccaactgtattgaaatcatctacagtgctgaccataaatatggatttctggtttctttcctcactctcaaatcaagatctttcaaggtagttctcaatattttaattttcatcaaagcccccatgttatttttctatagctaggtgaaagaacgccccccatcttttgttccatagctgaaaaaatagaagatgaaataatttaaactatttgcctcatattctaaaactagtaaatatcagacctagaatcagagcctacctaagctttctctcttaataatatttctgaaatgaccgtgtccattaataatgttcaacaccatatactgaactaattaaaggagaaaaaaggacatattttagacacatttttaacaataaagatttttaaaaatagagtcacttgaattaaatttaatcagattatgtttccacagttactctatttaatcaagcttttactatcaaactttgcagtagcattcttcagagaaccttgcaagcaagttctcttaagcacttctctcgaaggtatatgagatttaaataatggaagaagatacccatatatttttcccctggtagttgaaatcatttagatagttttatgtaaattttatgcaaatggaacacattttatgcccccaaacttatggtgatcataactactttattcaccaaaagttggccttcagcaagattctactgaggactgatgatctatgcagtctccttctgcctggatttttgtgacatttatcatcatcctacttggatactcaaaagacttgcaatatgtgaatataggactgaaataagaccctgattttccttcagccaagcctgaactacctaccacaagcacctggggatcattttttgtagtttcttctctagtttcttagtacaaatcatcttgattcatttatgtcataaagtaatagacattcaaattataattttactgagtaaaaagacacaccctggtatgtatggaaagtattactaaattttattagtttttaagagtgactgtttgccaatagctaaatttagaaagaatatgttcctaacagtgcagctctagagaaaatgttaaggcgtgatgatttcattaattttcagagcattacagccagctggcaaagccttttctataccattgtggcttactgcctttgaaattactttcttttcttaaattaacctgacgatgttaaagtgacaaaatagcaataacggtgtgataaaattggcctctttgtataatcttaaagtaacttaactaacttaaataatagtaccctgagtttatgactgctgcagtgtactccataaaaagaaattggtgttaagaacatttacagagccccatattagttttattgatagataaataacatttaaaaatttgaatcatatgtaaaatagaaggagacttctagctcaaaaagaaattccccatttaaaccctcaggacctagttgtctcacctgtggtggtggaaagagcaccaagcttggaaccagagggcccaggttcgggtcactgtcatcatgtgagcatgggcaggtaagagaatttctctgggtctcagtttccacatctgcaaaatggggatactaatattaacgctgccttcttctcaggttgttatacaaataaaataataaatgtgagtgacaacagaagaaacatattcccaagatttctgaggagtttgtctcatagagaggaaataagtcagaatgagtggttagactttgtagaatatgcacatcctacagtgtgtgcaggggagggtgctaaatgaggacaataatgtctgagcagcagcaaggaagggaggacacagggaaagataatgtcatgggaaccatgaggatggtgcttctgggaaagaggggttcagagggaattttttttataaggataatgaatgaatgaatggttagatgttggatggacaaatggatggttggttgaatggtaggatggatggttgaatggtaggatggatggatggactagataaacccctgaaccaccctgtaaagaaaaccatcagtcaaaatctcctttagggtggctgttcaatgggcagagaaggcctcagggtggcccagaattcttcaggtttaacatgtaagtcttttggtcagttttattttaaacttttgtacaaataccaaatatagctgtttcttgaatatggacaatggtggctgagctggctactttaggaggagcctcattccgttgttggaaggcttggctttcttttaagttgaactgaaatcttgaccctggcaactgctaccttgggtcctgaaatcttgaccctggtgactgtacctttggagtcacagaacattttcttccttttgacatatagcaacacttctctaaacagcatgttctagacctagatagggtggagatctgcattctgtttgttagcccatgattatcagcatttaaaacctccataaaacattacaagtcatgttagacttatagtaccgaaagttaatttctactttatctttcggatattctccaattcataaacacaaaaagcagatatacaagccatgcactagtcagggttttcaagatgagagcaccactcagaatgttcaaagtgtcaagttatcacaacaggaataaacaggccacaaaagtttactttatccatgttgtttgtgaagtagagtaatacattaatttttaaaaatatagtagctttctatatagtactatgttatcattgaaaaatggaattttcatcaaaaacctatcttctactttttcagtgatatgaaggaaaaattctttatcccagacatttatcattcaccctttaatattcatctacttctttatttatacatcgttcattcaccaagcacttatctaatttctactatatactgggcatttggctaagtgctagtgctagaggtactaattataataaggcatgatttttggtctaaaagggtctggtcatcaagtgtctgaagtaagaggccaagatgaggtgttaggaatgaggataagaaaaagagtttgcaggctggacgcagtggctcacgcttgtaatctcagcactttgagaggcccaggcgggtggatcacttgaggtcaggagttcgagaccagcctgaccaacatggtgaaaccccatctctactaaaaatacaaaattagtcgggcatagtggcacacgcttgtaatcccagctacttgggaggctgagaggcaggagaattgcttgaactgggaaggcggaggctgcagtgagttgagatcccgccactgtactccagcctgggcaacaacagtgaaactctgtctcaaaaaaaaaaaaaaaaaaaaagaaagaaaaagaaagaaagaaaaaagaaaaaaaaacatagcaagtaaccagtaagtgaaagaagaaaaggaaagatttgtagtgggaatagcagggcaatatggaatgtccacatggagctaggacctgccagagctataaacctgtagcattggaagaatcatattgctctaaattctttatctaccataagagaaaacagagattctgggggatataaggcaatggatgatttcctcagggctaggtcatttcaatcctttccagtggttcgatataacaccagatcacctcatcgtgctagtggaaggcatcaggcaactgggaactacctattccctataggattttgttctactgtattgccgtattgcaatgccatccatagtagcatactttttattttctgttataaatatataatctcatagaataagaatgtattctttcagctgctcattagttgagtctagttctcctcatataaagacttaaaaaaaaaaaaacaaacacctattttagtaacactttctggaacatctttaattttccagatgaattgttcactaattagtatcccaggagtgtgagtgctataaatgatagatactcttttaattttaaaactaagatggcttggagaatttttaaatttaagtcccaagaaaatttaacagaaatgctgataaaaatggtatgtcattctatgctt

SEQ ID NO: 486 - DNA, 26702 bp, Homo sapiens
tgcgcctggtcatatgcctgctttaaagcacccatttgaccctggaataattcagtttagcaactaattcgtcaaaaatgttctccaaaggaagagaggggaatgcgaagagcgggctgctttctgcggatcgtggtttaacgccgagtgccccccactggctgtgcagtcctgagaaggccactcaacaccccagggcctcagtgtctgcatctgtaaaatgagcagcagcatgacaccactcagctcccggttaccagggaaacacatgagagcgcaaataaaagagtaaagaaaaccgcctgctggaacccagtcaaaggtaaccactgtcatccgggtgtgtgttggggcggtggtggtctggggggtggtgtggatgcatgaggacacagcacctgatttacacgagagtacgagtgtgtccacaaaggagcagagccaataactggatgactgagactggatgactacatagtgtggagcccccagcccattttcaactgtggtctaagctgcgccccaggtgagacagctctcaggaaccaacctccttggaagggaatccatcctaaaccctgctgtctggctaacagcgggggggcccacattactgataccacagacacacaaaacatccctgcccccagcatggatctgttcccactatctcgtccctcattaaatctaaaccctattattgggccaagtcatttttaaataggccaaatttcccattgtgctttatctataagataaagtggtatagaagaaaaacttcctaagaatatccataaccccggttaattcgcccttaagggcctattccatattctctacacgtttacaatctcacaaacctaaaatattcaccgacaaatagactgtactgccaaaattgtgcggaaggtttgtattataccaaaactgaacctgtaagtttcacatcttataagcaaactgtaactggaagctgttagctatccaacccttcctatattacagaataacagccaaccttggaaacgaaacaaatcagaaagttaactttttaattattccagggctcctgtggcaaagttgtatcctaataactcactgtttaaacaatttctctgaaacactgactcaaacagccagccaatctgagctcttcttggcagtagtttgggcttataaataaggtcacctgcctgcaccagcatccttggatgcacggtcaggcaaacctcaaagagccactgggggacctttactgttcccccaggcccctcgaagttcttctctctcttctgtgtctcccaattccaacactttctattagtccccctccccagcaccgcagaccagccccggcacacagggtcagaggcatagaggaccggccaaacttctgactgctgagccaaggtttcctctccctcctgttcacctccagccccagagcaggtgagcgaggtgcccacactggctccaccactaactgggcaggcctcttcaacagcacccaaattacaagcccgcatccaggagcagaagccaagatcaaatgaggctatgcttttcaaagagcttgcacaaagccctacacacctaagcccgactgttattatctgcaggagacagaaaagccagaccaagggaacaccggctgcattatagggtgactcagggacccatctgacaattccaacggtcccaccctggaattaattggcactgggaaggggcagtgacctctgatcttcccagagagccctgtggctggctgacgaaagagcatctccaagcaaatcctgtgacccagatcacctggaggccactttttaatagctgtactcaggagccactagcctgctgaggaaggcgctgatccccggtcttgaacttgggagaaccgcaggcctgctcccaggaaaatgctgacggaagcggcgcggtgcctctccccctcgctgggcctaggccgggcgcccacccccagcatccaaccggcggcaacaaatccttgcagagttgcccgggcccggcccaattgcgccccggcatgccaggcggagcccttggcgggttcctgaggctctccaggaggcccatcaggagctactcctcccaccccgacggccactcaccagacacagacacctccatgagcgcctccagcggccggttgttgtccaggtcgcggctgagctgcagttcgcccgtggcggggtccagcagcaacaggcgcagctcgttgccctgcacgaaggtgtagttgaggctgtctgacacgtcggggtcatgggccgggatgcagccgatcacgccggtggggaaactgttggacttgttggtgacatagttgttgaagaggatctggaagtcgggcagcacaggcgggttgtcattctggtccacgagaaggatgtgcaccgtggctcggctcaccagcggagccgacgtggcctgcaccaccagcacatactcccgccggacctcaaagtccagctccaccatggcacgcaggtccccgttgagcaggtccagctggaagaaatgccgcatgtccccttccacaatctgatacatgatctgggcattagggccttcatcagggtcgttagcacgaatctttgccaccaccgaccccactgggttgttctcctcaacaaacagctccagttcgtccttctcaaacatgggggcattgtcattaatgtccaagatggtcacctggatttctaccgaggcgctaaggggagtgggactgccccgatccacagccagagcccaaaggttgtacacggccacattctcccggtccagccggcgctgggtgcgaatcacaccggacgtgggctcgatgtagaagtccccatcgccgtcgtccccaccctggaaggtgtacagcagacgcccattgggacctgagtcccggtccgtggcagagacctggaggatgctggtcgagggtggagcatcctcaaagatggaaccctggtagaaatcccacaggaactggggtgcattgtcattggcatcgaggatgaggatctctagggtggtggtgtctgatttctgcgggatgccgttgtcctgggccatgatggtcagcgtgtaggcgacctggttctcatagtccagctccatcatggtgtacatggtgccactgtcggggtcaatgcggaactgcggcacggggtcctgaatcacgtaggtgatgcgggcattctctcctgtgtcctcatcgttggcactgagggtagcaatggaggtgcccacaggcctgtcctcactgacactcactgtgtaatgggagctctgaaagacaggcctgtgggtgttggcatcagtgacgttgattaggacatgcgcagtgtgcgaccgtgtgccgtcggatgctgtcaccgccagcacgtactgctgctcctgcttgtagtccagaggtagcgccagggtgatgaggccgccccctctctggctgctgagtgcaaagcggttccgggtgttgccgcctgtgagctggtaggtaatcacactgttggcgtcacggtcgcgggcctgcagggtcagcacgctgctccccacggccgcatcctcattcagacgaagctcgtaggtgggctgcgtgaacaccgggtcgttgtcattcacgtccagcaccgtgatggacacgctggtggaggagctcatggggggcgagccgtggtccaccgcctccaccccgaagctgtagtgctccacctcctcgcggtccagctcggcacacactgtgatccaaccggagctgttgtggatctggaaggggaagtcaggggtgggggcaggattcttaggcccagcgctgccgccccccagaaaggtggaggccgtgtccaccaggcgatagtgcagccgggcgttctctccagagtccgcgtccaccgcctgaatgtgcaccacggggtagcccaggggcacattctccagcaccgtggcctggaaggggctgctcacaaagataggctcgttgtcgttgacatccagcacctgcacagacaccacccctgaagaattgatgagcgggggccggcccccatcctgggccttaatgctcagcgagtatttctggacatcctcgaaatccaaggggttgatcacatccaggatcccgctcagcgagtgcaggtagaactggccggccacgttcccgctgaggatgctgtagtgaatggccgcgttctggccctggtcccggtccgtggcctgcactcgcagcacagccgtgttgagccccacgtcctcgggcacctggaccacgtagttctgctcgctgaactgggggtagttgtcgttctcgtcctccacctcgatgtacacggtggccgtggcactgagcgggcccggattgcgcccctggtcgttggcctccaccaggagctggtactcggccgcctcctcccggtccagcaccgcccgtgtgctcaccacgccagagctctcgttgagctggaagacgtcccacgcgccccccaacacgcggtaacgcaagttggcgttgatgggcgagtcgcggtcgctggcgcggatggtcagcacctcgtagcccacctccaggttctcccgcacgcgctcgcggtactccgactgctcgaagaccgggctgtggtcgttggtgtctttgaccaagacagtgatgtaggtggtggccgagcgcggcggcgtactgtagtccacggctttcaccctgaggacgtgcgtctccttggtctcgcggtccagtacgctgtccgtgctcacggcgcccgtggcagagtcgattcggaagtagccccgggagcgctcgtcgaacagcccctccatgtaatagctcacgcgctcctcctcgccctcgatggtgtagtgcgcgtgcagctggaggatgagggtgcccgccggttcgttctcaaacaacgccacctggtagttgggcatcggaaacttcaggctccctctgccgctcgtgccccgccgggcccgtcgcgccggccccgcccgggcttcgggcaagttcggcggcaggggcggcgatggggatggcgacgcggagggcgtccccgcggtggcggcctccagcgccagtcccacccggacggcgccagccgcgcgccgcagggcgcacagcagacgcaggcggaccgagccgcccggcggcaggcagatgggacggccgggacagcggggcctggggcgcggcgggcagcggcaggcgggtaaggtggtcggagctgcgagcgccgaatgctgcgcggccgcgcagccgccggggacggggaagcagagcgccccgcagagccgggcaccggttccgcagagccgggcacgggctccgcagccgggaaggtgcgtgcgcgcccgcaggcggcggctcagcgccgtcggggcactgcgggccaccaagcggacttgcagcggcagcgggcgccccgcgcccgagacgcgccgacgtcctgccagccgcccatcgcggcccacgtccagcagctcccgcggcgcccggggcgtgcaagcggcgcccaccgcgtaggtacagccgggccggagggcgaaggcgcgggtcccgccgggtacgcgcggctcccaggcggccgctcgcagccccatcgccggcagggcggcggcggcggccaggagcagcagcacgggcagcacgggcggcggcggcggcgccatggcccggagcccgagcccgagccgggcgcccgaacacaatccatgcacccggcgcgcctccgcatccacccggcgaggccggggagcggctcccgggcgcccggccctcggggcggtccgcgtcccgcctccccgggggccctggcggggactgtggggaccacgcgcccggcctcccccgcagcttccacttcgagagcactttgcgaaagtttgcgaagttggtttcaagatggctcctccgcgcgtcccgggagggcgccgcgcatcaacctgcggcggcggcggcggctccaggcggctccaggtggctccggcgcgggctcggccggacgggcgtgggaagcggggcgggcccggcgcggggcgggggctgagttcccggagcgggctgggcagctccgcgccgcgcagaccccggcggccggctgctgcctgggcggtgcgcttggcccgcgcccactccgcccgcgctctccccgcccccggcccggccccgccccgcccccggcccagcggcgtattgttcggccccggggggagccggctcggaggtgcgcgccgagaggatcgctatggagacgcgagggcgcggccgggacggggactggggccctactccccggaggcctccccacccagcctcccggtggggcggggccgaggcaacagggccgggaaaggtggggctggggcccccggtggccgctacccgtggggcggtggctccgcacctcgggctcggggccgcggctcagagcctggctccccaccccggcagaacagatccacggagaccgccgccaggagtgccgcgcgggtaggacccgggggcggaggactggggccgagaggccggggagcccccccccacccattaaggactgcggaggctgtcgaggagggttacccattttacagcaagacgcacggaggctaaaatgcttcaccccgactaaaactccctggactttgaagcccaataggcagctaccggatctgcgtcccacttggtttaaagcgcaacttttaaatgaaagaagaaaaccccggttgacataagggatttggagaggacggcggaggcgcgctcatctcccgcgtgcggcccgacccgagcgttcgcggacgcatcgcggaatccccgagcgtccggctcctcccgaagcgggttgcggggaaggcggggggctgcgggtcctggaagctgcctggggcaagcaagcacccgcagggatttagagctgtgccacagcccctgcccagcctcctacggaggacagcggggggcggggggcagagaccttagagctttcagaaaagtgacacacacccccgcctcctgcggggaaccacggggggccgggggcagctttaggtttgcgtgacgggtacacctgcctccggatggggcacagggataaagggggtggaggcttaggacttggcgaccccccgcatgggcggggctttgggactgtgccaccagcggctgggaagggcgcgcactcccttggtggcgctcggggcgccggagtccagtgcagcccttaggcctcccagtggtcggggacggtaggtgggggtcgcctcttctctcctagaagggcttctcctggggccggtcggagcggtgggggtgggagtaatgcgcagtcacccctagaacgggtctttttggcaagggagggtcggatcctgcagccaaatctctgagctgagctgagatgagtccagtctcaacgaggaccgtgggcggctgtggagaaccggaagggtttctcccccggagcgatgtgtctgtgtgtgtgtcacacgcatactcagccaacttcgctcaaagctgctgaaacagtgtctttgtgctgaagcccaatgtgagcattttcttcccagtagcaaggatttgaacacgttatattgatctaaaaggtggagttgctttggaaccttttaattcgaggtttccactggagagtcctgttgggaaatgtgtgtgtggagggaggggaggaaggagaaaagtccgtctccttaatgtgagcggtccaggacctccccacccgccatatacccttccactgggatttttccgggaaggatgaaaggacaggagttctggggccggaaggcagggcgggtccctgagcccggagcctcccagtggaaggctactgggcggacctgaaggggacccaggcaggaggaaaaaccagagaaccccaggagtgcctgttttgcaataaggctttaagcagagtgggttgggtttaaataaacaaaactcagctgcagccagtgggttcaggtgtgggcctgcttttctggaataaggcacctgcaggctgcgaggtaaccacagggactgcccaacacctagggacaggggaggatggatgaatctcactaacaggatgtccagcaaagacaaaagatcattccattcacgcttagaccgacagcaagcccgactccaccataacgtttagaggtgtgcacaaataggggaaagatgaagaaaaacaaggaggtgattatgggcacattcaggagggctctgggggaggaggggcatccccttctggacctgagggttaccagagtgtcggcttcatgatcacactttgaactccaaacacatgatttgcgtacttttccctatgcctgcatctagagtcggcagtttttgtttttttttgttttgttttgttttgttttgttttgtttttttgagacagagtttcactgttgttgcccaggctggagtgcaatggcacgatctcagcttaccacaacctccgccttccaggttcaagcaattctgcctcagcctccctagtagctgggattacaggcgtgcgcctcacgcccggctaattttgtattttcagtagagacggggtttctccatgttggtcaggctggtctcgaactcccaacctcgtgatccgcccacctcggcctcccaaagtgctgggattacaggcatgagccaccgtgcctggcctatttttatttattgctaaatagagatggggtcttgctatgttgcctaggttgatctcaaacttctgggctcaagagatcctcccacttcagcctctcaaagtgctaggattacaggtatgagccaccacaccctatttagagtccacagttttattttattttactttatttatttttgagacggagttttgctctctcacctaggctggaggacagtggcgcgatctcagctcaatgcaacctccacctcctgggttcaagcaattctcctgcctcagcctccagagtagctgggattataggcacacaccaccagtcctgactaatgtgtgtatgtttagtagagacggtttcgccatgttgaccaggctggtctggaactcctgacctcaggtgatccacccacctcagcctcccaaagtgctgggattacaggcatgagccaccgcgccgggcctagaatccacaattttaagtaagtggggaggggagagggactaacaagacggaggccgcagcttgtgctgagacggccaggtggtccggccgcatcagaaatcacgagtttggaatgactggcaccttcgaggggttgagctttaattctgccactaactagttgtgtgaccttcgccaaggcctaactccttgttctaactggacacaatagtcctagactcctagcgttgttgaaggattaacaagacaatctgtgtgaagcggtcggcacagggtctggctcaggcatggatctgccagtaatagcatttactattttcacagttgctgtttcctagcatgagttcaaggctgcctcctctctgtcttcattatgtgaattgaatgtggtcacacatctgtgttggagcagaggcaggggctgcagctttcagctgatttcccaaggggtctgtacttggacactgatccagtccacccaatgtgtttccagaaagtggagctgattcctggagagcagaagggatatatgtggggctttttgtaaagggcagtgacctatgtggtgggcttgtccactgcccgagtctgcggctcccacaggtcactgcccggctcatatccttcccctttggaattggcttggagcagggtctctcctccccggcccctatgtgcccaccatctctggggtcagtggcccactcatgactctcagggcggggagggggcttggagttcagtaacagcaccctgggtcattcttgcacctgtcaccctgagagccactgaccagttttctgtgcctagaatcgctgcttgcggcctttctcaggggctcaatggattgtaattgatgtttgtattttgcacttgcccggaggtgtttcacgggaagtgagcattttttaaaacaaaaatagaatttagaaaaaaaaaaggcagacacgatggatttctagtgttgtacgtgctgtagaaagcacttgaaaatgcgttttgccaggggccgcaaccagaagctacatgacttctggaatctgttccttacacagtaaattcctgggccagttggtaaacagcaaggagccacaagaaatcactcataggcaaaagccgagtgagcccaggccaagctccactttgtccactttgccctatttttggaattcagggggaaacatcttgggagcaggcccattgcacccctctgcctcctctcgatgccttacagttggtggggtttgacacatggaaaattgtgaaagttagaacacggaacaaaaatgaagcctcaacatagagttaatagaggcaaggggctacagagaatttagatcctaatcaagcacgtcttatgtactagcgcttccctggaaggccaggataactttatgactacaaagaaaacatgttttcctgcttggaagttgccagaacttgtctaatataaaagctgggatttcttgcccgtgggctgtcgcgtacggctacccaggccgcctcgtgaagcctcctcctgggagctcggcgccctcaggtgctccctgagatgccagcacctgaacgacctgctccagggaggctttagccccaagaaggttctggaaagctccaggaagtttagccggcacgcacaaaagccagagacaaatctccagcctgcctggaaatgctgtgggctcagggcaatgggctgaggtcttgtgtccaaaactgctcttgcatctccctggggagcccgggtgggcaggaacaacaaggtcctgtggccatgccctcgccccatgctcacccacactgcctgtgcctgctgggcccatctcagggctgcactggcccctagtggccaagcatgggctctacccctctgcgcctgcctggctgcctgtgcaggtgcccaccacactgtccctgagcagagcagagaccagcctgagccccgggctccgtggctaccatgctgagagtgagccctgtgcatgcacacacacttacgatgctgctggccccgagcagtggccggccacacgggctgctagtcatactgcccgctgctcctgggactcctgagcccctcactctctatagggtgaggatgcccagctctgcaagacacacagcaaacggagcctcagagtgcacagcgtggagatggggctccccccacaggctgcacccccatctagtcccggggaacgagaatgaagggcctacctgagcacacaagccccaggagggcatgggagctgcatttgggggcagtgactgggagggctgctgactccaggctcaggtaagggagatgcacgtgttcccggaagagggtccacacctgctgagttcacgctgctgaatatccttgctcctatcactattattatcattgtcgtggtcgatcttgtttcctggcccccacctgatgcacataaacgttatcatggagccaatatgggggaatattgtctcacttgattactgttctttttttttttttttttttctgagatggagtcttgctctatcacccatgctggagtgcagtggcacaatctcggctcactgcaagctccgcctcccagattcacaccattctcctgcctcagcctcctgagtagctgggactacaggcacccgccaccacgcctggctaatttttttgtatttttggcagagacggggtttcaccatgttagccaggatggtcttgatctcctgaccttgtgatccgcccgcctcagcctcccaaagtgctgggattacaggcgtgagcctgcgcccggccctgattactgtttactgattactgattactgttcttctttacatacctccctccctttttatttccctgaaactgggtctcactctgtcacccaagctggagggcagtggcatgaccacagctcactgcagcctcaaacccctgggcgcaagtgatccttctgcctcagcctcctgagtagctgggactacaggcacataccactatgcttggctaattttttctttttaatgtttgtagtgacagggtcttgctacattgcccagactggtctcaaactcccaacctcaagctatcttccctcctcagcctcccagagtgctggcattacaggcataagcctctatgtctggccttatttatttatttatttatttatttttgtttcactcttgtcacccaggatggaatgcaatggcacgatcttggctcactgcaacctccaactcccaggttcaagcgattctcctgcctcagcctcccatgtagctgggattacaggcatgcgccaccacacctggctaattttttgtacttttagtagagatgatgtttctccatgttggtcagggtggtcacgaactcctgacctcaggtgatccacccacctcagcctcccaaagtactgggattacaggcatgagccactgcgcccggcaaaacctgcattttcttgcaccatctctatctctaagagaagtctgagtgacctacatttaagttctcaagttaaactattacatttccctgcaaccttggtgcggtggctcacgcctgtaatcccagcactttgggaggccgaggcgggcggatcatgaggtcaggagatggagaccatcctggctaacacggcgaaaccctgtctccactaaaaacacaaaaaaattagccgggcgtagtggcgggtgtctgtagtcccagctattcggaaggctgaggcaggagaatggcgtgaacccgggaggcggagcttgcagtgagccgagatcgtgccactgcactccagcctgggtgacagagtgagactccgtctcaaaaaaaaaaaaatgagatcaagggccaggtacggtggcacatgccggcaatcccaacactttgggaggccaaggtgggtggatcacttgagcccaggagttcaggaccagcctgggtaacataatgaaaccccatctctaaaaaaaaaaaatttttttttttttgagacggactctcactctgtccccaggctggagtgcaatggcgcaatctcagctcactgcaacctccacctcccgggttcaagcgattctccttgatctcctcctcagcctcctgagtggctgggactacaggtgtgcaccaccacgcccagctaatttttgtatttttagtagagatggggtttcaccatgttggccaggatggtctcaatctcttgacttcgtgatctgcccacctcaacctcccaaagagctgggattacaggtgtgagccattgcacccggcccaaaaaataaatgtaaaaagaaaaaaaaaaggagacacacttcacatatcttaaaaattacccactttaaagtgtacaattcaatgctttcagtatagtcacagagttgtgtagtcatcaccgctatctaattccagaacattggatcaccccaaaaagaagccccaaagtcatcatcaatcccctgccagcccccagcaactgataactggcttcctgactctatggatttgcctgtcctgggtggtttgtgtcagtggagtcacacactgtgtggcctcttgggcctggctgctttctcagcatcacatttcactgttcctgcacattggggcataaattggtgcttccttccttttgaaggctgagtaacgtgtcacgctgtggatacactacagtttgtttatctactcatcagccagtggggatttgggctgtttccacttttggactcttttgaataccctcccttccttttgagtggagaaaaaagggcaagacattccctctgcaaaattgcacacaaaatcttttttaaaattattctttttatattttggcattgtaactactactaaccatgctgtcatcaacggctcaaagaggactttccctggggactttcctctgcccctgctgggtatagggaggagcactaaagttgccctgagggccaggcacggtggctcatgaccgtaatcccagcactttgggaggccaaggtaggtggatcacctgaggtcaggagttcgagaccaacctggccaacatggtgaaaccccatgtctactaaaaacacaaaaattagctgggcgtggtggtgcgcacgtgtagtcccagctactcaggaacctgaggcaagagaattgcttgaaccggggaggcagagattgcagtgagctgagatcaagccactgcactccagcctgggtgacagagcgagactccgtctcaaaaaaagaaaaaaactgttctgaggtaggattggcagattgggggtgggggaagccagtggcccctacttttctgtcccctcctaacacgctcacccaccccctgatgctgttgctggacaggagggccacccaccgcagcagccgtgagttgatgacactctgccagcctggccttgtcctccctggccccccgcttatgtcctgattggaatggggaagcaagaacaaccacacttgaaccacccactgtctcctttccttcatgcacattcagccattcattcaatattcattcaataccgtggtagacatggacacccctccccccacagagagattattgtcatgggagaatacagacagtacatgtcagattatttttttctcttcctgaacttgcaaaacttttctggggtgcaagagagatgggcaggtgattgtgggcaagaacgattctacaggaatgggagagacccagaaaagctagagacagtgtcagcattctaattattattattggttttgtttttgttgttttttttgagacacaatcttgccctgttgcccaggctggagtgcagtggtgcgatctcggctcactgcaacctccgcctccccggttcaagcgatcctcctgcctcagcctcctgagtagctgagatcactcccggctaatttttttgcatttttagtagagatgggatttcaccatgttggccaggctggtcgcaaactcctgacctcaagtgatccgccccgccttggcctcccagtgctgagattgccgcatcctaattatatcattgtatcttctttttaaagattaaaagacagacggcaacactggggttgcagagctcaggagccagtcctggccccctgcctcctccctcatgaggttcccctgatccccaggacatcggcttccacatctgcacatctgggagacaaatgcaccatcagggagggcaaatcatacctgggaagggcctgactccagcagtttcagcagtggctgaaagatcatggctatttttgccatcattacaatggaatgtccactccctccagccacctccacagcaatcaacaccggtgtccagccactctacatggacgtgtggggaacagagcacaggcctcttggcttggctgtggtcaccgggagggagcagggagggacagctgccaagaggatgggggagggagcctgctactcaggaacgctggggcaagacatgagacaaagggctgccttcacccaccagtaggagcctgaccctgagcccaaagaaactgcccacctgtgtgctgaccccagggcctgaggacaggtccccaagtggacgtctcaaagagagtcccacattccagggcacatgggaactatggccttctggcagctggagggcagcaggaagggcacagctgtctgagacccgtgtggcttcccagaaagaggtgccacccctgaggaggcaccggtgctcacggactcctggttgccagtcttgccagggcaaaaaggcaagcgaaggaaaccctctcttcgtggggcactctgccttgcagtgtcaggtgagatcccggggggaaagctggcttgagctcctctggaatgtgcagggaggactccgtcaggcccggctctgcctccaagctgggcagcaggcgagccccagagctccaccagccccactggcagaggagggccctcacgaggcaggagcccatgattcatgccctgctggaatttgtcgagcatgccgagatttgcagctcctccgagattgggtcctgccctgatcaaaagaaaagaagatggatgaggacactataaataggccagagccacccagctggcctcggggatgcaggcggtatgtgttctgggctctcacgaagctaagaaactctaaatccaaggtgacatcgtggcacaccgccacctgcttcagggggacacaggggacaaggaggagctattggcagagcgctcggttcctgcaagttccaacttctgctaaaattggttaattggttcctttgcatgattcagggcacacaggcttctctgtccacaaaatttgctcgcctgcacacccagagaaatggacttggcttggtttttctgaacttttgcctctgcggaatcagcagtggacgtgtgagctggggcctctgtccctgtcatgtgaggaggtcaggcaggacaagcaggaagcactgggcaatgagtcaggaggcctggtggggagcttgggtgagtctgttttcctctctggacctcagtcttctcctctggttgatgtaataaaatcctacaaactgagtctttttttttttttttgagacagagtcttactctctcacccaggctggagtgcagtaacatgatctcagctcactgcaaccttcatctcccgggttcaagcaattctcctgcctcagcctcctgagtagctgggattacaggcatgcaccaccatgcccggctaatttttgtatttttagtagagacaaggtttcaccatgttggccaggctggtctcgaactcctgacctcaggtgatccacccgccttggcctcccaaagtactaggattacaggtatgagccactgcacccagccacacaaacttagtgttttgttttgttttgttttgttttgagacagagtctcgctgtgtcgccagctggagtgcagtggcgcgatctcagctcactgcaagctccacctcctgggttcatgccattctcctgcctcagcctcccgagtagctgggactacaggtgcccaccaccacgcccggctaattttttttttcttagtagagacagggttttaccgtgttaaccaggatggtctcgatctcctgaacttgtgatccgcccgcctcagcctcccaaagtgctgggattacaggcgtgagccaccacgcccggcccaaacttagtcttaaagttaacttagtcttaaacaagatgctgattatctgctggttgcggaggtcagcggtctgagatggctctctctacatctctacatgggtgaacgtcacaatgtctgccttgttggggtcaagccaggttctgctgggaagccagtgctcgtggtctgccagagtccaggacggggctgtgcagtcggcaggagggtgagtgatccatcagtgtcactcctggccagggtgttctgggaggagaaggggggctttgtttgagtggaagccaggagcattcccaaggctggcctttggggggtacccactgtgacccccaaatcctcaccacacttcagagatgcttcctgaggccaagactggggcaaagctgcttcatttcatctgggccatgcaccattgttgggggcctgcctgtgcccagccctgtgctggactctgcccctaatttttcagatatgtggcccgcccttggtaagtcccgtctgctgtgctggggagacagacatacacacatactcggtcaaatactgtggagcaaaaccaagggacaggtcactctagagagacagtgaaggggggtgtctgtgaaagctgtccagggtaactgggttttgaaggttctccaggcagacaagaatgttgaattccagccaaggggaaaaacatatacaaagacctagaggaatcaaacagactctgtgtggcaggggagaatttgtgactataggcaatttaatattactgaggggtgaaatcgtaggggtggagagtagggtgggagttgaggccagaggtaggcaggggtgggttaaggggtctggcctttgtactgcaggcactggggattttcagctgtagagggacaaggtcagctgtgcatctgagagcatgggtggctggagaagagcaggggtcggggaggagaccagttgagcatagaaccagaggcccatggtgagatgttgccggaggacacaggtgaagaggcggctttccatcctgaaaggatgtctgcccagcataacacacagggcaccagaacccacccacaatgactctggccagccaagaggtgggttaccccaaagtcccacccaggagcttctttggtggaggaggggactactgtccccaggctgccagtctcagagataacgagagttcttgtctttctcatagtcagcagttccaacatttgagagtcactgctcacccacctgcagtgatgaggggggttgaatctctttgtttctgcctctgtaaatgtggacacctggcccctttactgtggcaatactggcgggtgaagccccccaacccgtgtggagaaggggctccgagaggcccccgctcccgcaccccagtcaggtgaatatgatcgtgtccttttgtgatcagcgtggggacagcagcaggaattagagcagtgggacaggcaccagcacccactccttcaggccgggctttctccccatctcccaccccgttcactcctgcaaggggctcttctctggccagtgaggcgaaggccagaggagaggggtggggatgcctatcctgtcctacctgccttcaccgcggagcagggcagtcggggccagtccatgcggcaggttctgcctcccgggacaagcccagagccaggcagcctttctcactgggtccgtctgggtgggctcctggaggtggggatggcatctccaaggaaaggactggaggtgaggcttgtggaggggaaggcagacctggggcaggagggagggattccagaagcttctggatgggaggtggactgcagggaatgtgggatctccccagagagaggccagacatccccggtgtcgggagctgggccatggagggggagtttggtgaatgccctggccatggcccaacaggacagagctttggctttagtgtaaatcagaatctcccctctaattttggggtgtggacatggtaacaaattggggctcttccgggaaataagagggggacggaccccacatttccagggtccaaaaaaactctacctccctctatgccccacatgcccagagaaggtgtagcttctctgctttgcctgtaaccctctgagtgtcctcctgagccccttctgctgggcagtgggcacaaaacgaggccagcccagctgggcacagtggctcatgcctgtaatcccagcactttgggaggccgaggtgggcagatcatgaggtcaggagtttgagaccagcctgaccaacatggtgaaaccccatccctactaaaaacacaaaaattagccaggcatggtggcatgcgcctgtaatcccagctactcaggaggctgaggccagagaatcacttgaacccgggaggaggaggttgcagtgagccaagatcacgccattgcactccagcctgggcgttctgagtgagactccatctaaaaaaaaaacaaaaaacaaaaaaccgaggccagccctgtgacatcagaccccagatccctcccctcctccactgccgtctctccagtttctgggtgcttgaggggatgatgtggcttatgtggccgcctggtgacaggggttctcagggcctccagcctgagtctctgcctcctcatcctccagcctgctgtcccctgaaggacccatgtcccgctgtcctggctcccgctggcgttggcaggtggggggctagggacaggtctcctggcctcagcttgccctagaacttggaccctccatctgctaccccctgctcccatgctgctgcaggccccgacagtctcctagccgcttctgggtcccaggaatgccaagcccctagcctccagctctctggccacacggaccacattgcacaggctggtgctggagcagcccatgaggccatctccgtctggggagcagaattctgacacggacccaaaaggagctttgtggctctctgcagagctgatggcccaggaagcatctcatttttaaagcaataatgccactagatggacagagctgaggaaatgctacatggccgggacaggcgagggtgggtccagcagctggaagccccctggatcgagggcagtcctcccgtggggctgtggggagacttctccctctctccctcaaaatggcctcccttagcccctgcctttcttcttcttcctctctctgagctgctttgcctgcttctccaggcaccctgtcatcggccagagctcctgggctcagctctctccccagttcaaatgaacggctcctggcgaacgagaatcttgtttctaattcccagttcccaagctggcctggtctgtgtgaagcagctacatggtcaagtcatcagcgtcagacagggtcatgagactacacataaaggtgttcaccgagggctgcacggggcccgagacccagcccagcctggctcacccagcccggctacctggcgtgggctggctgctgctgggaagggcccctctcaaatgcacacaggcacaacggcagctgatgacaaatggctccactccttcctgccttcacgccttctgcaaggtgacatttcagctcatgggaaggtgggagctatttccccacccctgcaatctggcagatggccttatgatttgttctgaccatacagtgaggcagaagtgatgtcagttctgagcctaggccttaagtgctcttctgcccttcaggagccctgtgtgccagaggatgagagaccacatggagccgagagcagctgtcccagctgaggtcccaggaatgtgagcccagctaagacagcagagccatgtcgccaacccttagtgacctcagaagtgagcccatctcagatcagcagagccactcagtgggcctggaggctcacgggaaagaattaatggttgtgtttgaagctattacatttgggggagttttgttacacagcaatagataactgatacagacatcccatggactatctctgagcatcacatactaaaaatgtgactgcaggagcagttaatcagagaagcagggtctcactgtaactcaaacagagacccccagctgtggctatggcctctccagaggagaagagtcatagtggttaagacacatagacagagcctgaaggcaaggttcactgtgtggcagccaatctccaaaggtggccccagggaaccatgcctcctggtgtttccacccttgtttagtcccctcccacacagaatctggattggccctaaccctcacattaaccaacagaatgcagtgaagtgccactgtgccagttccaggcctgagacttaacaagacccagcagctttggcctgtgcgttctcaggagactgctgccacctaagaagtctgaccagcctgatggagaggggctacccagaggacattgagggtgcagagatgtgagtgataagtcatcttggacattctgccaccatctgacggcaactgcatgagagaccacaagcagaagaactacccagctgagcccagccaacccacagaaccctgagaaataataacgaagtgttgtttcaatggtgtgtttgttacgcagcaataggtagctggtgcactctacttaccagccaagggttcttgtgcaagtcatttgcgtgaactctactgcactttgcaaatgggggtgattctcactaatctaagccaggaaagtctacctgctcaccctgggtatcatgaagaacagctttagaacaatactttagttccctcttacaaagccataaaggttccagaaatgtgaggttcagactcagagaacccagtaatctatcatcccaaatacacatccgagagggttgttcccctcttgaagggtcaccggcagctcctcatctctggacctttctgggtctgccctgcccactagtcagccccatctcccatcccccactggccccttccccagtttgtacatttgacaacgtatgacttggtgttctagctgcggctcaaatgctgcctcctctgacaccttccctgtcctctgggcaggctagggtgctcctcatctgttcccacaaccactgcatcatgcattacagctgtcactgtcctgtattactgtctccctaatgatgaccccagagggccaagaccagctccttccactgtgtggcactgagcagagggtcaaatacagagggaagatcaataagtactcctgggccaggtgaggtggctcacacctgtaatcccagcactttgggaggccgaggcgggtggatcataaggtcaggagattgagaccatcctggctaacatggtgaaaccccatctctaccaaaaatacaaaaaattagccaggcatgatgacaggtgcctgtagtcccagctacttggggggctgaggcaggagaatggcgtgaacccgggaggtggagcttgcagtgagctgagatcacgccactgcactccagcctcagcgtcagagcaagactccgtctcaaaaaattaaataaataaataaataaatactcctgggtgaatgaggtcgaggccagcgctgccttcatgggggcagcatctcctagggagacagacccccccaagcagggacacaggtagcaaggctgggctggggacgagtgagtgtgagaggaggagggtgtgagggctggagagccctcagggtaagcagagcttaggcctgtctccgagggggtgtgggattgctttctgttgcactcaggcgtttctgttcattttggccgtctgcaaagcagcccattaggttgtatctgtggtgcctaaaacggagaggaaatctgggagttttctaggtaacgtccaatccagatgactggcttgaacaattctagggctcttcccactaccaacaccctcaacacaccccagtgcaccagcacacacacaggtgccccctcactctttctgctgtgcattccggctgcactgagtcgcagcatctcactggctgccctcagaggaacccatgaggtcaccaggaagggggactgctgcaggaccctgaagcttggaaacaggcatgagagctgaggagtaagcagcaggggccaggccccattccatggcttagccagaaaatgtacaccctgaattctctccaaagtactcctctggagcaaggtgagagccatgttggcagccaaggatgtaactcccagaatgagctaatgagtcaacttgacttctggcagcatagtgatcagatatcccaaaatgccatccgctacctgattgcaagtaaatgtctacagacataacattattgcactgccaagatcacaaggaagccctccttccacaaaagaaacaagcaataaataaagcaaactatctggaaccagagatgagcaataagcactttccttaggtaatgcaaaatgcagagtggtgagtgggggtagtgaacctaagagtcctacaccgacttgagaccctcaaaggaggctacccgcctaaggagagggtggttccaaccaaatctgcctgccaggacagggatccctctgggaaacctgggtgtctgcttcagagctccaggtggaaacatttaagaacaataataatgtccctggaggatttgcaaccatttgctctcctgcagcgctgaagttaaatttacactatcctcatagacgggaaaatccccactcaagaaattaaattaaattggtcctggtcagtgataaaatggtagaggcaaacagaaattctttctggaggaaagcatcccaatttaggccttcaggattcctacagatgaagcacaaccaaatacacacacacacacacacacacacacacacacacacacacacaccccaaggagacaagccaccataaggcgagactcaatagaaataacaaatagatttagacccctgagaactgcttgaaataaatgaagtgccggccaggcgcagtggctcgagcctgtaatcccagcactttgggaggccaaggcgggcggatcacaaggtcaggagattgggaccatcctggctaacacggtgaaaccccgtctctattaaaagtacaaaaaattagccgggtgtggtggcgggcgcctgtagtcccagctacttgggaggctgaggcaggagaatggcatgaacctgggaggtagagcttgcagtgagccgagatggcaccactgcactccagcctgggcaacaaagcgagactccgtctaaaaaaataaataaataaaataaataaataaataaatgaagtgccaggcgtggtggctccacaactgtaatcccagcactttgggaggccgacgtgggcagattgcttgagcccaggagttcatgcctgggcaacatggcgaaaccccatctctacaaaaatgtacaaaaattagcggatgtggtggagcatgcctgtagtcccagctactcaggaagctgacgtaggaggatcacttgagcttgggaagtctaggtggcagtgagctgtgatagtgccactgcactctagcctgggagacagagtaagactctgccaggaaaaaaagaaaaaggaagggagggagggagggaaaagaaaagaaatagatgaagtctattcatctatcaatttttcctttttgattgtcttccttattccatctaaggaattccagctaaatctgcctttatattaaagaagttttttgtttttgttcatttgtttgttcgtttttgagacagagtttcgctcctgttggccaggctggagtgcaatggcacgatctcggctcaccgcaacctctgcctcccaggttcaagaaattcacctgcctcagcctccaaagtagctgggattacaggtatgcaccaccactcccagctaattttgtattttttgcagagatgcatttctccatgttggtaaggctggtctcaaactcccaacctcaggtgatctgcccacctcagcttcccaaagtgctgggattacaggcgtgagccaccacacccagccgattaaggaggatttaatggaataaggaagatgatcaaaaaggcaaaagagtctattggagaaaaaaaggccagagagatttgaaaaagaaccaaatatacttttacaagtgaaaaaatacaaatgttgaaactatgagttaaacagctaaagagagaatcagtgaaatggagcacagatacgaagaaatttcctaggatgcaacatagaaagatgagaagagagaaaatatgaaagaaaggtaagaaggctgggaggagagtatgagtgagtctaatgtgcatctaatcagaattcctagaattccagatccctggatgaggtggtactaagtgggggcaatgggtgggggtgcagtgcagggctataccaggcagagggaacagcacgtgcaaggccctgaggaacctaaccaaagctggtctgctagggcccttactctgtgctgccttatgcagggcaatgctggggcacagatggggcttaaacactgtccctgcctgagcagtaggcagtctactggggagccagccacagtgaggtagacagccgtgctactgcctggccaattccatttccccttcgactgctaactatacctcttctcctccccagctctcaggccacatagcccaggcagagctagccccagtccttcatgcttcagggatggacatgtgacctcggccaggttaatcacagccagtgaggtccagttctcaaacttttgttagaaccatcgggcacaggaaatctctggtttgtccaggggtgctgacaggggagactgttggtctggaaccaccaagagatggaaccaacataaagaaaggcccccgttgagccctggatccaagttttctgaaaataccctggacataatgttacagaagttaatagatttccttttctgtttgagctggtctgagctgtttttttctgttacgtataactccttgctctgtccctgaaacagagggaaatcccaaggctggagaacccatgggaggacctggcccagcctaggggtcagtgaggcttcttatgggaggtgataaccaggctgggtcttgatagctgcaccagagttagctggagggaagaggtgcgcccgggcaggctggtgcaggtgctggctgccttcccaggagtcagggcagctcactggctcctgggcacagtctctgcccaggcaggccctgggctcccaggtcagctcttagcagaggcttctgaggacctcagggtttggcaggaacaggaggcctaaagaggggacaactcggaagcactgcatagggtggggcaggccagcctccaagggtcttatttcatgtgccatgttggtgtcaggacctccaacctcaggatccactgaggtttgtgagaggagctgtg

SEQ ID NO: 487 - DNA, 74223 bp, Homo sapiens
gtaacactttcttcccacgaagagtaagcacgtgttctcaagagcatgcatgcccaagcaattgatatcagcagctacagttaagagaaagagttgctgccatcgctgagctgtggggtcagcttcttcctcataccctgtgatgttcccatggtgcagggttcactacagggcccagaatggagctgtgagcccttgccgcatagcagacggctaagaagaaagagctagggggtcgcacagctgggacccgtggagcattggcccctccagtgaagtgaagcaaggctctgagttggtaatgggctctgcagcaggcaggatgtccaggctgctagggaccccttctcgagggggccggacccttggcatccggtccacatgtctggtattgggtctggcttcctgtagggcaatgggtcttagttttctttgagagaccagtaaaaattctgaaaagaaacgcatatataaacacaccagtttgctagggggtcttggaacggatggtacgcagtcacagatatgtgcttgggctctagactcaagaccacctaagctcaaaatctgactctgagactcagccaactgttagctgtgtaccttggaggtttaattaggctaccccctagctctttcttcttagccgtctgctatgcagcaagggctcacagctccattccgggccctgtagtgaaccctgcaccatgggaacttcatggggcatgaggaagaagctgaccccacagctcagcgatggcagcaactctttctcttaactgtgttacttggcctctcttagattttcctctccttctaaatagcaataaaaacttccatagggctgctgtgtgattaaatgcgatagtacttaaatgtagtgttgccaccacgcggtaggagctcagtgatgttcgccatcatgaaggccttcagagaggatctggcatgaaaaacttgaatcactgccctgtaagttgtactttgagtgtcattagccttttgaaatatcagataaccagggaaagggcgaacatgaatttctgtggctgattatgacaccctggttatgagttaagggacttcgctccttccttctcatatctcagtacacagataaacttcagagtcaactctgccatgtgggaagctaaaggtcagtgcaacacagctctgtttttgcccactgcatgccatcacaacctctgccctgctattcagctaactccaggaagggacatctcccctctttctttgtgatccatcattgtgaagttaacaagaatagatccagcccatagctctaggtctttgcttctcttgcctgttgagtcatgttgtttgacttgaaaaggcttgacgtagaggtcaaaacagcctaagatccttcctaaataagtgtttcgcgtgcttcacatgtcccagctactgcagacatcatgagctttcccttttctctctggtcctcacatttcttctttgccctcaccaaaaatgcttatggtaagcattattttgtgactgttccatcatcttaatccagtgaaatattctaaaacaaaagatctagaggtttaagatgaatcttctagattctgaggtcagaggttatattaaaaggagaaatctggggccgggcatggtggctcacatctgtaatcccagcactttgggaggccgaggcgtgtggatcacttgaggtcaggagttcaagaccagcctggccaacgtggtgaaaccctgtctctactaaaaatacaacaacaaaacaaaattagctgggtgtgatggcaggtgcctgtaatcccagctactcgagaggctgaggcaggagaattgcttgaacccaggaagcagaggttgcagtgagccaagattgtgccactgtacgccagcctgggcaacagagcgagaccctgtctcaaaaaaaaggacttcattaggttcagtggtctctggaatctggacatattcactaagacctttaagtaacatttggttgctctgcctgactcgtctcaacctgctgtgaaatctgctttgcaaccagctgtgcttcctaaagaaaggcagattttcagagacaagctgcaaatcacttggctttgcaaaatcgcctgaaattattaaaaaataacacttggccccaccaccgtcatcactctgttaccaagctataggatcttgggaagggatgtcatttctctgagcttctatttttcttgtctgtacaaatcataactaccttccaagtgtattgtgagggtcaaatgaagtgtttgtcacaggacctggctcccagcagccactggaagtttggatgttgaaagtattgttcccactcagacctcacaggtttgctaagaggcaaactagaagcattttataaaccgggaggagctatgtgaatgcatgatggcactatgtaaagttagtctgcttatattgtctgtctttctctgctttctaaaacatggggggctgggtgcggtggctcacacctgtaatcccaacactttgggaagccaagtcaggcagatcacttgaggtcaggagttcaagaccagcctggccaacacggtaaaactccatctctactaaaaatacacaaaaataataataatttagccaggcatggtggcaggtgcttgtaatcccagctactcgaaaggctgaagtaggagaatggcttaaacccaggaggcagaggttgcagtgagccaagattgtgccactgcactctagcctgggcaacagagtgagacttcatctcaaaagtaaaataaaataaaataaaacgaggggaaagcctggtttctgtttctgaagagttgccagcctctgccattaaagataaaatgactatttccaggctgtgttacaaaactctagaatgttagactctagtattctagaacaacattgtgtagtacatgtgtggtttctttggccctaggaagagggtgggagtgtatacaaacagttcccagcagtgtggttgtgagtatgtcagcattgtagcgggattgtatacaaacagatcccagcagcatggttgtgagtatgtcagcgttgtagctgtggggcagactcctcactcctccagacctcacctatgaatgaccttaaaagtgaaagtttgtactttttaggggctgcaggatgcccaagcctaaaggttattaattttcgtattggattctaaatggatatggctgtaggaggggagggagtgacagagcgtgttgcaaagaagcttatctaacacgtttttgaagagagaggctgtaggaagcagtggtttatcgagatggtgtagcctgctcgggcactggagacctgggtcctgggcttatctctctcattagttaatacatcacctgagccagctgcctcactttttggcattttaggtaccctcacaagtaaaatgactgttgttggatcagctgatgtcccccacacacccactctcatacccacctgggctgtctagtggtgatgctgtgagttttgttttatatttccctaaagaggtgcgaccgtgactgccgatacctcctgctgtggccaaagcacttctctgagacttggcctgctggctgcttttgaagaccacctctctcctggagcatctgaggagttccattctgtgtcaagttttccccccacctgcaggctcaccatagccaagactaccccaaatgcaatcccttgtgacatttcagtagccgggccctttgaagacaggatagctgcttgaagcagagatgatcctaaatgtggtccaagggtggtccccagagcagcagcatccgtatcacctggaattgttagaaatgcagattcttgggccccagatcagacctacggagttagaaattctagccagaaatctatgttgtaactaacaagccctccatggggattgtgatgctgaagtttgggaaccactggcttggagtatcttactctccagtaagtgtggtatcaaaggagttcagtgggttgctacttaacacaactggactctagtccagtcaagtagttgtcacacccctagtccccattgaactgtgtcttctttagccacttcttagaagcccttttctttcacatactaaggaaggactaagactctagcaaaaacgtgaccttcaagagttaatgaacagactgggtgcagtggctcatccctgtaatcccagcaccttgggaggccgaggcgggcaaatcacctgaggtcaggagtttgagaccagccttgtgaacatatagtgaaactccatctctacttaaaaaatgcaaaacttagtcaagcatggtggtgcacgcctgtagtcccagctacttgggaggctgaggcaggagaatcacttgaacccacagggcggaggttgcagtgagctgagatcacaccactgcactctggcctgcgtgacagagcaaaactccatctcttaaaaaaaaaaaatagttagtgaaccaggttgggtgcagaggctcatgcctataatcctagcattttgggaggctgcagtgggtggatgacttcagcccaagagtaagaggctagcctgggcaatatggcaaaacccatctctagtaaacatttttaaattaggtatggcggtacatgcctgtagtcccagctactctggaggctgaggtgggaggataacctgagcccagaaggtggaagttgcagtgagccgagattgcaccactgcacttagcctgggtgacagaggaagaccctatgtcaaaaaaagaaaaatcctgtgttttgaagaatccaggcctctgtggctcagcaaacgtaggtggctggagagaggacggaccgttacctaaatggtgtggtggcactgacctgtagtcccagtgctcaggagcctaaggtgggaggattacctgagcccaagaagtcaaggctgcagtgagccatgatgttgctactgcctgagtgacaggagtgagaccctgtcttaaaaaaaaaaaaaaaaaaaaaaaacggccaggcacagtggctcacacctgtaatcctggcactttggaaggccgaggcaggcagatcacttgaggtaaggagttcaagactagcctggccaacatggtgaaaccccatctctactaaaatacaaaaatcaaccaggtgtggtggcacacatctgtagtcctggctactccggagattgaggcaagagaatgtcttgaaccccaggaggcagaggttgcagtgagccaagacagacctgctgcactccagcctgggcaacagagtgagactccgtctcaaaaaaaaaaaaaaaaaaagttaatgcacatgagaatctgacctaagaagacttctatgttaatatgctagtctctcctccacacaagagtcaacaggaagtggtattagcttctgattttggtattggtcacctgaccaaatacagtaagtgagaggtgacagcgtgctggcagccctcacagcccttgcttgctcttggcgcctcctctgccttggctcccactttggcggcacttgaggagcccttcagcccgtgctgcactgtgggagcccctgcctgggctggctgaggctggagccggctccctcagcttgcggggaggtgtggagggagaggcgcgggcaggaaccggggctgtacgcggggcttgtgggccagcgagagttccgggtgggcgtgggctcggcaggccccgcactcagaccagcaggcctgccccgctggcccccggcagtgagaggcttagcacctgggccagcagctgctgtgcttgacttctcgctgggccttagctgctgcctccctgtggggcagggttcgggacctgcagcctgccatgcttgagccttcccccacccaaccccaccagccatgggctcctgcacagccagagcctccccgacgagcaccgccccctgctccacgttgccccttcccatcgaccttccaagtgagaggtgacagcatgctggcagccctcacagccctcgctcgctctgggcacctcctctgcctgggctcccactttggcagcacttgaggggcccttcagcccactgctgcactgtgggaaccccttcctgggctggctgaggcctgagcccgctccctcagcttgtggggaggtgtggagggagaggcgtgggcggaaccggggctgcgcatggtgcttgcgggccagcccgagttccgggtgggtgtgggctccgcgggccctgcactcagagcggccggctggccctgccggccccaggcaatgaggggcttagcaccccggccagcggctgcagagggtgtgctgggtcccccagcagtgccggcccaccagtgccggcccaccagtgctgtgctggattttttgccaggccttagctgcctcccggcggggcagggctcaggacctgcagcccgccatgcctgaacctcccccaccctccgtgggctcctgtgtggccggagcctccccgacaagcaccggcccctgctccactgcgcccagtcccatcaaccaccccaagggctgaggagtgccggctcatggcgcgggactggcaggcagcttcacctgtgacccagtgctggatccactgggtgaagccagctgggctcctgactgctggggacttggagaacctttatgtctagctaagggattgtaaatacaccaatcggcacggtgtatctagctcaaggtttgtaaacacgccaatcagcaccctgtgtctagctcagggtttgtgaatgcaccaatggacactctgtatctagctactctagtgggtacttggagaacctttgtgtccacactctgtatctagctaatctagtggggacgtggagaacctttgtgtctagctcagggattgtaaacacaccaatcagcaccctgttaaaacagaccactcagctctctgtaaaatggaccaatcagcaggatgtgggtggggccagataaggaaataaaagcaggctgccccagccagcagtggcaacctgctggggttcccttccatgctgtggaagctttgttctttcgctctttgcaataaatcttgctactgctcactctttgggtctacactgcctttatgagctgtaacactcaccacgaaggtctgcagcttcactcctgaagccaacaagaccacgaacccaccgggaggaacaaacaactccagacgccccaccttaagggctgtaacactcaccgcgaaggtccacagcttcactcctgagccagtgagatcacgaacccaccagaaggaagaaactccaaacacatccgaacatcagaaggaacaaactccggacacgctgcctttaagaactgtaacactcaccgccagggtgtgcagcttcattcttgaagtcagtgagaccaagaacccaccaattccagacacacaaaggctgaggagtgtgggcacacggtgtgggactggcagccagctccacctgtggccacggtgcgggatcgactgggtgaagccagctggcctcctgagtctggtggggacttggagaacctttatgtctagctaagggattataaatacaccaatcggcactcagtatttggctcaaggtttggaaacacaccaatcagcaccctgtgtctagctcagggtttgtgaatgcaccaatggacactctgtatctagctactctggtggggacttggagaacctttatgtctagctaagggattgtaaatacaccaatgggcactctgtatctagctcaaggtttgtaaacacaccaatcagccccccgtgtctagctcagggtttgtgaatgcaccaattgacactctgtatctagctactctggtagggacttgggtaacctttatgtctagctaagggattgtaaatacaccaattggcactctgtgtctagctcaaggtttgtaaaccattcagcaccctggtctagctcagggtttgtgaatgcaccaatcgacactctggatctagctaatctagtggggacatggaaaacttttgtgtcaacactctgtatctagctaatctagtggggacatggcgaacttttgtgtctagctcagggattgtaaacacaccaatcagcaccctgtcaaaacggaccaatcagctctctgtaaaacagaccaatcggctctctgtaaaatggaccaatcagtaggatgtgggtggggccagataaaagaataaaagcaggctgtccgagcccggagtggcaaccacctggggttcttttcacactgtggaaggtttgttctttagctctttgcaataaatcttgctactgctcactctttgggtctacgctgcttttatgagctgtaatgctcactgcaaaggtctgtagctttactcctgagccagcaagaccacaaacccaccagaaggaagaaactctgaacacatctgaacatcagaaggaacaaactctagacacaccgcctttaagaactgtaacactcactgcgagggtccgcggcttcattctggtagctaaacatacacagatcaatggggcagcataggggccaaggcactgcaggggttctcatgactctgagtcaggtgctgtcttgaccgactggttgtgtgattccagaagccttctttcacctgaaaaggcctcactggcctcacctatacagtaagtttgcacatcatctccagggtttctttcatttctacccactgtttttgtttagtaatgatgccttgcagtcctaatgatcttggaatcaagaatggtgactagagaacttcaaagtggaaagagaggctgggcatggtggctcatgcctataatcccagcacttcgggaggccgaggcaggcagatcacttgaagtcaggagttcgagaccagcctggccaacatggtgaaaccctgtctctgctaaaaatacaaaaaaaaaaaaaaaaattagccaggcattgtggtgcatgcctgtaatcccagccactccagaggctgaggcaggagaattgcttgaactcaggaagtggaggttgcggtgagactccgtctcaaaaaaaaaaaaaaaaaaaaaaaaggagagagtaggatggctgagccatgacgcagtagcaatgcttctttttttttttttttttttgagacagagtctcgctgtgtcgcccaggctggagtgcagtggcgcgatcttggctcactgcaagctccacctcccgggttcacaccattctcctgcctcagcctcccaagtagctgggactacaggggcccaccaccacgcccggctaattttttgtgtattcagtagagacggggtttcaccgtgttagccaggaagcaatgcttcctattctagcgccttgctaaactatgtgtgctgcagactgtgttcgtgattccgaatcctaaaaacaaccgtcctaggcttgtctctcagcctagactctagactgatttggctcatttggttgtcttggagacgttctaattctgaagggggcagtggtcccttctagaagatagctggtctgcaaatgcacacctctgcttagtctgaatcctaaagttatagcttgagccaattaaagtggcttctcatttttctctcactctgatctcaaggagccctttttcttctagtaatctagaccttcctcttcctatcacagtctcaaggattgtgcccccaaagcagatgcaaagccctgtctaccccttctccttcccctgaggtagagctttatcgaaggtttctcttggtaaacgttagctttctgaactaagggccgtcttttttttttttcccgcttaagcccattgcataacaatctcttgttttaatcttttgcccaacactgcttttcttactgtcagaggttactacaagtgtttgaacaggtaacttctacctttgaacttctgttgtgacagattcaaaggttccaggggagtgtgttggccactctcaggacagtacacagtagcttcgggtgtgtcccagtcagtcctaggagctgtggaaagagtagaagtgcctgaatgtggtgctgaatcaatacagccagctgtgaggggagcacttcctggacccaggaagggagagtcttcttccaaggtaagctgcaatgatactacctgcactatattgaatatatctgtgagatagtagggaggggattggtgtggggaaagaaagtgggatttgttatgctcaacctaaggctctttaataacatgaaattacatttagttgaatagtaatctcagctgacttgtgtgggaggcaaagaaaaaaatcagttggaaaaggggtggagatatatgagctatccaaatgctagcaggggatggaattggaagggaacactgattttggtaagtgtactaaagcacaccaagccagaatgtgggtctccttcatcttccattaagaaatttctgtctcagtgtagttagaaggatcgtgcgtcagctgctgagggcagagagtcccatttggcagacagagaggaagggaatcagcagatattcgattaggtgctggggactgttctgggtagattatgtatgttacttcattggtgtatctcatcctataaagcaggtggtatccttcccatttcacagaggcatagtgcgtctccaggctgttaaacagcatggcctaagctacatagctccaaggtggtgtggctagaatttgagacttgattggtcagtttccacagcctgcccaataatgcagaattgttgtgggttgccaaagctttcagttaccccctgaaatcctgagggtgtcactcatgtgcacagaggattgataggaatacaactctgatgggcctttagaatgactcaaccttcctgaacttgagcatttttactggaggaggtcaataaaaaaaaaagaaataaaacctcatcttcccctggccctgagccctttggtgaaggaagacagcacccggtgaagggctcagaggtattagtgtggctgagattcgacacccactctgccatcctctgctctcctctagaggaagttgcctcttggggagctgagttcctgaaactaagcaaatgacaagtgctcctccagccgtgagatgagccagaggatggaatgccacaggccccacttcgtctcccagcccttcatctttcttccatgtccaaaggcggctccccagaggccaagggctcagctcttgtgttctctgagactgtggcacagctcaccctggcttccttagtaggaagcttttaagaactgctctgtagaaagaacaaaccctaatctagctccagcaaagagccaggatcatgctgaacttcctgtgagccttcgtgggggatcgaggctggagaaagtgctgcttcattctgaggtatctgtgaggtggggaaggggcaggaaaatttgtcatttcggcttcctaatctgagaatggtagctccagggcccccctgtagccacagccttaggcggatcaaaaatgagactaatacaggtcctggtaatactgggggtgaccaaggcgaaagaatcgatttttaagttaagttttgaggtgtgactgtatcagagggaaagaaaccatgccaattgaacgactcacagccctgtcgttcctgacttgcttattttcttggctttgccagaacttcttcagagaccaaggcaggcagctctggcgactggagagaggcggggtagaaggtgtttgtgtgggtctgagggctgaggtaccctctagccagactttcctgtcctccgaatccagcagggaacagcgtcacctctgcctctgtgaggcttctgatctgagggggcacctcaagtcattttagtttgtttgttttcatcttagttgaaagatgataggccacaggagggcagggtcaactgtgttgaggcaagctggcttttgtgtcggcccttaggggctgaggtgaaaggctttgacacggagccagggtagctttggcagcttctcccctcctggtcagaacacttccactttcagttgtgaaaaaaaaaattaaaaccaggaagtgaagtccccgagcacgttagaaagcctgacatggcctgactcgggacagctcagagcagggcagaactggggacactctgggccggccttctgcctgcatggacgctctgaagccaccctgtctctggaggaaccacgagcgagggaagaaggacagggactcgtgtggcaggaagaactcagagccgggaagcccccattcactagaagcactgagagatgcggccccctcgcagggtaaggggaccatcgagggggtgttattcagcaagggggtcttgtgagggtgtgacagaggccaagggggcatcctgacccccgactttctttaagcgacttagaatcaagggccggctgagttccacgggcacatcatgctgtctccctcctggtctcggtcatgccttcagaccctgtgtcaggaggagcaacgggaaggaaggatgtggggcatgcatggggctcactttccttctctcgactctcttggggaaggtgaaccaaaacagagacctctttttgtgggtctgagcatccagcatagctcccctgaggtgggctgggggtttgccctcaattttatgttgggtaagactgatgaatgagaccaatggggtgggagagacagatgaatggagctgagtgtattttaggaagtaaggccacaggttaagtctcaggtgctgcttaattcctaagtacttccttcccaatgcccactccctgagggtcctaaggtgaatctcaaagaccctcagggagtaagcactggaaagggactctaccactggagaccctcagggaataagcactggaaagggactctaccaccggagaccctcagggaataagcactggaaagggactctaccaccggagaccctcagggaataagcactggaaagggactctaccaccggggcttggtaccttctgagatatcagcctttttttggtggtctgaaaggtagaattgaatctatagctccaatgtgtaggtgattagtattctatatcagaggcagagtcttaaaaaataaagttaaggccgggcgcagtgactcacacctgtaatcccagaactctgggagtctgaggtgggtggatcacctgaagtcaggagttagaaaccagcctggccaacatggcgaaaccccatctctactgaaaatacaaaaattagcttggcgtggtggcgtacgcctgtaatcccagcaactcaggaggcaggacaattgcttgaacctaggaggcggaggttgcagtgagccgagatggcaccactgcactccagtttggatgacagagcaagactctggctcaaaaacaacacacaaacaaacaaataaaaaaacattgaaaactgacttagttttcttttaaaaaaggagtaattggttttgtttatttctcccttcatattctgatatggagtcactctgtggtagtcccctccgattgatcagtattcaaggttaaacacagaacatgtcttgaaagaggcatggtgtaaaattttatagccatcttttgtgtatttggcataataaaaggaacaaaaacctaaataaaacaagaagtgtaagtgcaaatgcttataggacaggcaagtaatatagagaagtaaagtagatggtgtgtaataagatgctaatggtggaaactttagcaaaattcagagcaggcataccccagataaatgcattcaaatttaattattaaaaaagagaaaacactttttaatccagaccaaacagaatatttcagcctagcctgacctaaaatagtctctcccaggctatattgtaattttttgagggcaaagacaccaacaacaacatcagcgtgtcattgcatacctaaccatccacctatagtgagaccacagatactacatggaggctggagatggaggaaggagagagaaatgaatggagagagggaagatgaagccagggaagtaccagtacacagtaggtactcttatatttaatcaagacaatcttcttcttcttgtttttttttttttttttttttttttttttttggaggagcctcactctgtcacctagactcccaggcttgagtgcagtggcaacatcttggctcactgcaacctctgcctccccagttcaagcaattctcctgcctcagcctcctgagtagctgggattacaggcatgcaccaccatgcccaaataatttttgtacttttagtagagacagggtttcaccatattggccaggctggtctcaaactcctgacctcaagttatctgcctgcctaggcctcccaaagtgctgggattacaggtgtgagccactgcacctggcctataggatttgccagcttcttagaaaccaggaatacagtgtctgctcctgtctgtctctcatatgcctcctcagcagatgagcagaccctcagctggagtgcagtcagaggtgactcttgtgcctggcagcatcaagcaagggtgacgtaaccccagcagccatgagtccagccatcactgcttatcacattctgctggaaatgcatctgggtctatttctcccctctatgtctgtacatcctgaggtcggaaagggactctctcaccaacttgtcctccctggcgcagggcctgacacttcctaggttctcaactcattgtttgaataaatacatgagatctggagtttggaaggtcagacagcccgtgcaatgctgtggtcaggccacactattagccttctttggggaagctggtggatctcccagtcttcatgggccattctattctaagagttgtgaggttgcgagtggctcaagttgaggatttgaggtctggggtaaagctaggtcagagacaggccatggttccctacaactagaagtgctctgtttaaatagaaatgagggcttgttggccgggcgcagtggctcatgccagtaatcccaacactttgggaggccgaggcaggcagatcacttgaaatcaggagtttgagaccagcctggccaacatggtgaaaccccatctctgctaaaaatacaaaagctagctgggcgtggtggcagctgcctgtaatcccagctactcgggaggctgaggcaggagaatcgcttgaacccaggaggcggaggttgcagtgagctgagatctcgccactgcactccagcctgggtgacaagagtgaaactccatctcaaaaaaaagaaaaaaaaaaaaaagagatgagggcttgttaaaacctttgcacagaagtggaggggcagtaatcgttcaagaccgtggtcatctcttttcttttgggacatctcgtaatagaacatctgatattggcaaggatgtgaaaactgaggaaaagggaaggaaaggggagctagatttgattgaggacttcccatgtgcctgacagcataccaactgttctacacacagcatctcctttaagtagcgattttcacctgctccttctgtgtacagtggcggggaactgatgctcagtgactctaagtaactgtccccagggctacacatgtagtaagtgaggagctgttgctctggtacctggaagggcacgaccttgaaagtttgcccctggcaatgacaccgttgacaagaaagcttgttgcctgcactttgaaactgttgacccttgaccactggttgggacaggcagtgcaagggctgattctgcagaaaactaaggcaagaagtctgctttcccaacctcttgcctcaccctggcacaggtgacagggtcctagcactttgtccggcctatctttttacagacccccttatcagatccagtggacttctgacactgcttcttcttaccccagttctgtcataatatacttggtcagcagcaggcctgggatgccctttgggggtgttactgacacaagttgtcccggggtcgggatttggactgtgactcacttgaagcccagtggtggatcaaggttgactctatcgacctgagctcctgtgggatttgtcacttctggggtcacatcctgtgggtgactcaactatcctatgctatcttaatggactgacttaagaggctcttggtatttgacttaacatgagatctcctgataaatgctactcagctcaactggccaatgtctggccccacccaggctctctggagtatgtgaaggcaatggctccagaggtgcagtgtctacactgggccccacacaccatctcattcatccttggagactttttcttccccctgccaccccccgccccccaaccttttaactaaagatggaccctccacctccagcagaaatacctcttcaccatttccctcccctaaatgtcccacttgtcccactttagtgcctctagcacatctggccattccccttctccacttccatttggctccatccaacctaatgagatgattggtctctccgtgaagaaagtagatagagagacacagacaacagttgagaaagatggtttggtggcaggcccactggttggaatcatagttgagatcttactagacatcagcttgattggtagaattgtcatccttttttgttttgtttcttaagacagggtcacactcttgtcactctgcacatccaggctcccaggctggagtgcagtggcgggatcatggatcactacaacctcaacctcccaggctcaacaatcctcctacctcattctcctgagtacctgggactacaggcatgcccaactaaattttttatttttgtaaagatggggtcccactatgttgctcaggctggtctcaaactcctggcctcaaacgatcctccagcctcagcctcccaaagtgcagagattacagggatgggccatcatgtctggccagatcatcatccttgcccctggaaagagacaattggcaataaagccagggggtcaaggatcacacatctttgaggttctagtgttccatacagccgtcttaatgtgctccagtctgcactgacctcttcctccttcaaaaccatgagctcactgcacacactgaagcattctgtaagagtttctaggactagatagacccataagtacccagatggcaggaactatatcggccaagtgttcatccctcagcacatggcacagtgctgaacacacaggtccacagtttttgtttactttactgaaaataaacgtataggctgggtacagtggctcacacttgtaatcccagcactttgggaggccaaggcaggtagatcacttgaagtcagagttcgagaccagcctggccaacatggtgaaaccccctctactaaaaatacaaaaattagccggatgtgatgatgcatgcttgttgtaatcccagctactcgggaggctgaggcaggagaatcgcttgagccctggaggcggaggttgcagtgagccaagatcgtaccactgcactccagcctgggtgacagagtgagactgtctcaaaaaaaaaaaaaaaaaaagaggccgggtgcggtggctcacacctgtaatcccagcactttgggaggtcgaggtgggtggatcacgaggtcaggagtttgagaccagactggccaatatggtgaaacctagtctctaccaaaaatacaaaaattagctgggcgtggtggcacgtgcctgtagtcccagctactcaggaggctgagacaaaagaatcgcttgactccgtctcaaaaaaaataaaaagtaaatgtgtaaataagttaaaagtgcagagagtaaatgtatcccttgccacacagacacttctccagcccaccaggtgctgccaaagctgaggtgcatcccatagagcactggtctcaaaagcatcatggctgcctggggaattggctttatcttctactggaccagaagttctgagcatgctttcctgtgctaaacacactgcctggcacacagtaggtgcttgaatacccaaatggatacattatgagggaacccgccctcacttaggtcggactgcttagcgttgcccttctcatggcatgaagcccctggctgtggcattcctgaggaagactccgccgaccctgtcctgctgtgtgcatagaagcatgttctgttccttgtgggattgaacactgcaaactttccttcagcagactctcctcgctagttgcctttctctcaaattgtgccaatggtgagtaaaaggtgaaggtggcttggtaacagcagcttcccactgtgtctcaggtgccatgctaggtgcagtggaatccacaggtgaggatggtcactatgtgcatgagtgctcacagcactgggaggcctattgacacacagatccatgagtcccaggaagcctcactgggacccaaacccgaggaaagggcttattctgctccacctcttctatctcttctgagctctggctcctgtagcttttcctgtgcaattcagcagcaaagattttaccagtggagctgcatcgaacgccctaatgatttatttatggtatgcttgcctgtggcccaggacacctgtctgaagcctagactcttaaccctttctctgccagctgtcttacacattgggactgttagatgctgtctagcaattgggcttggaagagagatatgagaggttattatcacttatcttttaaaaaattacgtaagcaatcgaattgaatctttccatggtgtggaaactactacttagctaccacctggtgttttaacagggctccctttggtaatgctgtctccctgctctgtccaccacctctcggcggagatgataagaaggaccttccccactgggtgccatggctcatgcctgtaatcccagaactttaggaggctgaggcaggtggatcgcttcagcccaggagttcaagcccaggctgggcaacttagggagaccccatctctacaaaaaacttaaaaacaaaaaacaaaaaacaaaagccgagtgtggttgtgcacacctgtagtctcagatacttgtaaggctgaggtgggaggatcacttaagcctgggaagttaacactgcagtgagctgagcatgttaggatggggctgcgatagcgccactgcattccagcctgagcaacaaagcgagactctgtcccaaaataaatatataaataaataaaataaggcccttcccatctgcctggggccatggctattataagacaatggcttgagcaactggtgaatggctgggaagttatcagcaggctgtaggtcaggatctcaggccatccttccttcttagctacttggaatgaatattgaaagacacagtttcagggcccctcggccctgtgactcagccttcacctttgctctggtttcttatcggttagagaaatggatgaaaaaggtttccacccacagagctgctgtccagctggattactcagtggctgagaagcattttacacaacatgagggcttggaagaggctgtgtgtcaaatgtagttttggtagcgggagagccacacttgtagaaacaaagctgaggtgtacacttaggtgcattcacatgaaatgccaccaaccaaggtggtagaactttctaaattagctgcctgtgttggaggtgggattatatggagctgttcattttattctttttttttgtaagtgtgcatatttcagattaaacagtacacatcaagtgttaccttcccactgagactacgctacgcctccctaattaaaactcatccaccaggcgcggtggttcatgcctgtaatcccagcactttgggaggcttgaggcaggtggatcacttgagaccaggagctcaagaccagcctggacaacatggcgaaatcctgtctctactaaaaatacaaaaattagccaggcacacacctgtaatcccagctacttgggaggctgaggcatgagaatcgcttgaacccaggaggcagaggttgcagtgagccgagatcacaccactgcattccagcctgggcaacagagcaagactctgtctcagaaaaaaaaacaaaaaacaaaaatctcatccccctgctgtacccccagttctctttccctactcttgttgtttttgttgttccgtagtcctaagtaacctagttattgctcaggcttgttgtcaaactccccaatataatgcaatctcacgagggcagggttttccctgctatatccccagcacctggaacaatgcaacatatacagccaagcccttcaatagcttttggctgaatgatggagtagacaagactttcaagaaatccagtcatgatttctcctcttccatctgtctttttcttgtttttttgttttgttttgttttgttgttttgtttttgagacagagtcttgctctgttgccctggctggagcgcagtagcacaattacagctcactgcagccttgacctccctggctcaagcgatcctcccacctcaggctcccaggtagtggggactaccggcatgcaccgccaagcgaggctaatttttgtattttttgtagagacaggtcctcaccgtgttccccagactcaaactcctggtctcaaactcctgggctcaagcaatatatccacctcagccttccaaagtactgggattataggtgtgagacactgcacccgacctccatctctctttttctatgaggattgtcttttcagaaacacaaatgcgtatataattcattgtaattgagaagataatgtacacactgtccaaatatttttttctttctccctggcagtacatcatgagctcttttcatatcattacctacagatcgactttcttttttaaaatacctgcccagaattccattgtgtggaagtactgtaatttgtttcattcttctcctatcaaggaaggctttcctaggcttttggattagaaacaattctacagctttaaaggtgataaatataatagttaatacatgaacctgcgtgccagccatggttctaagcactttatatatccattaactcttttaatcatggtgacagccttagaaaggagatgccattactgccattttatagatgagaaaccacagagaattaagttatctgccccaggtcacaaagaaaatgaccaagaagagcttgagcccaactagtctgagccaacattcttaacctgtactttacatgtcatttgtgatgtagtttattgatctgatgtctttctatgagataagctgatggtagaattactaggtgaaagggcatacattttatgatgtgtagagggcaatagggacttctttaagagacagcgtcaaatgtacatttccacaattcacgttgcatttctcaccgtttcatcactggaatctgatgcacgaggaaaaggcatgtcatttaaatctgcattcttaagaactataagcaaagttgaatgtctttccctaattgtaaataacttgcttgttttgctgtgaactttcagcaagctctgcccttgctttattgggttatattttgtttttcattgttgtctgagtttcttattaaagaaattaactcttagcctatctgagggggttgatactttttcctcaacgtgtctttgtctctggtatcttttctgcgggaaaatttttatttttatataatcaaacttgccaacatttctgtttatagattttaggtgttatgtctgtcttgagtcttccccatgccaaattataagagaaaatctctccatactttttcaccccaaccattcttattgttttcattgttttatacttaagtctttgacctatcttcagcttatttttgttgtaggagtaagagagtagacagcttaatgtattctctctgaatggctagccagttgtctcagtacgtttattttaagtgaaaaaatacctattttgatttgaaatgcaatttagtacatgataatagcatctactgggcatgtttcaggatgattttattaaataggtttgtctattcatgaccaatagaaaactcctatagctcttttttttttttttttttttttttttttttgaggcagagtctggctctgttgcccatgctggagtgcagtggtgcaatctcggctcactgcgatctccacctcctgggttcaagcaattctcctgcctcagcctccctagtagctgggattataagcgcacgccaccatgccaagctaatttttgtattttgagtagagacagggtttcaccatgttggccaggctggtcttgaactcctgacctcaagtgacccgcccgcctcggccttccaaagtgctgggattacaggcataagccactgtgtctggccagaaaactcctatagctctatagtaagtatttaaatttggtaatgattgctggtctgccacctacccaattcctgctatttttcaaaattgtttcactctttgttaagttttatttttttctggatgtactttagaattagcattttagttcctaagaaagccttcattagggttgcattaaatgtatagatacctttaaggtgacaggaaccttgaatatttcaggtatgtctttccatttttctagccttcttaggtacttcagatctaaacttttaaaatataggttttacgcatttattcttatatacactattgtgaatagcatctttttcatgacttctaaatcagttatttgtataaaatataggaaagctattaactctctgcataccaattttagtaactggccacctccaaattatctcagtaattataaaactgaaacatactagttacctcttatttccttagagggtttttagaatttctcctctcagctctttttttaaattttgttttgttttttaattgggagatatgaccacagatttttatgtcagatctgaatgttgaccccttggattttgaatcattttaaatagcttgggtagctgagaatagcttcccttgggggacaatctactgggctttttccatatgatgcttttctttgactgagttttgtgaagcaagatcattgtctcaaatcacctcatctgtcatatccctagtagaagaaaactacttatgatacagaaaagcaaactagtttaagaaatgattttttaaaagcccttcatcccagggctctgaggaaattgggtgaaggatcttgcaacagaacacacacctggttcacgttcatagcatataaaggaaaaggttatcagctctttccaggtatgctcatgatgctaatggtttgtaatttcatactggccttttgtcattacttttgggtttgtctagaaatactgactctgtagtcaaggactgagagagaggtttcctaggttgagggtggcaggaatgtaggaaaaatgattttagaagctgggttagaaatggaaatcccagctcaaaaagcaaaactttcatatacagcctcgtaaataacacacagttccctttggagtcattataagttgtaaagacttttgacatagtctctaggagagagtaggtaattcctagtatggaagaatgtgttaactaattgggtgtaagaacttgaggatgctggtctcctttttaattagctttctatcaccataggatgagcccatacatgcaaaagaacacagaaatcaattaaatacaaattaatgaaggcagatttttttaaagcttataattgcaatttatgtcttattattgcacaaaaaaataatagttctccaggcctaaaagcaaaggtaacagaatgatttatttgttcctttttttttttttttttttggagacagagtcttgctctgtcacccaggctggagtgcagtggtgtgatctcagctcactgcaacttccgcctcccaggttcaaggaattcttgtgccagagcctcccgagtagctgggattacaggcatgcgccaccaagcccagctaactttttgtatttttggtagagatggggtttcgccatgttggccaggctggtctcgaactcctggcctcaagtgatctgccctccttggcctcccaacgtgctgggattacaggcgtgagtcaccgctcctagtccagtatgatttatttcttggctggactttctacctacttatcccatgtagataacttcattccaactcttctaagcctggaggagtagaaggatcttgaatagtccttaatgtgtgtcagaaatacacccctgtcaccagccaccatccctatccaataccttaccaaagtattgattagggagcaatcctctccagattggcctgaatgacttcttatgatctaagatttgggggtttaagggtggggtctttgtactgcagggaaaatgagttaactgagagtatatggaataaacaattgtgacctggaaaactgttcatttgctcaacaaccacttgttgaaagttttttatgtgccaggcatggtgggggcatcagagacacagcagtaaacaaaattaaaatctctgttccaaagagaacatcagctcagttggcacaatgagtgataaggagctaggactatttcccagtgaacagtgtcatggagaagagaacaaagtccatgacactgactggaaaggtaaagacaatattcaataaggtgatcagaaacagtgagcctccgaggaagtgacatttgaggtgaggcctgacctatcagcaatacacaaccatttcagatctggggaaatgttccaggcaaagagaagagcaaatacagaggcttccagatgggaacagacttcgaatagggtttgagtgggatatatacataggaaaaatacaatcttttaaaagatagagactatcaaaagaaaatgatttttagccaatagggatagtatgaaagattcatagcaataaacatagttgaccaaaaatttaaatattagagtagaaggagccatttaggacatttatccaaagaaaaggagactaaatgaagacatgctgccccaagtccacaaaaggaaaaaaatccgaagctgaatatggggtgatcataacctagacaccaagaatggtccaggaagcatgcacagaggtgtgaaggcagaaggcgtccttcagctaacttgggaataaaacatgttaggagccaggagatgagtgactgtggctccagtcatccatccacaggagaggggaaggccctggagtggatcaaggacaaggatggtggacaaatgggcatcctggggtctgaggccaaggcatgtcaccatcaccacgtcaaaaagtggagtaagccttttgacatgggacatcctggtgtgtactggggcttgttcagctatttgtatattacgtgaaacaggaaatcccagacacagcatgacagagccctctttcctcttttctttaccactattgtgcttttccctaccgtaaccaggagtgatgttaaaaggaagaggaaatgccagtcacgcccactgcttacaggggattctgtggagtgactaaaccagagctgtagtttgagtcacacaggacgtgtgacaaaaggagggtgacttttttcccccttgtttctttgaacttacttggaagtgttaacagattctaatggttagaatggtaaacagagcttcctactcctgtcgtggtttgacccaggagtctcaccttctctcaggcccttagtttcttccacttaaacagtgagagagttacatgatatggttgcaaatcctctcagcgctaatcttgtaaggttaaaaatgtttgagtgtattgggcattaaaaaggagactatacaccaggcacagtggctcacgcctgtaatcccagcactttgggaggctgaggtaggaagatcacttgagcccagcagttcagaaccagcctgggcaacatagtgagacaccatatctaaaataaaattgttaattgtaaaaaaataaaaataaaaaagagattatcaagatagtaaaaagacaacctacagaatggaagaaaatattgcaaatcatatctctgataagtgttgtgtgtatatatatatatgacctaatttttaaatgggcaaaagacttgagtagacatttcttcaaaaaagaaatacaaatggccaagaagcacataaaaaaatgctcaacatccttagtcattagagaaatgcaaatcaaacccacaatgaggtaccatttcacacctactagaatggctatttaaacagacaaagagaaagtagcagtgttagggagaagggaaagaaattggaaccctcttacattgctggttggatataaaatggtgcagctactgtggaaaacactttggtggttccgcaaaaagttaaatataaaattcgcattgactcagcaatttctctcctaggtctacaccctaaagaactggaaaaagatattcaaacaaaaactgtatagaaatgctcgtaatagctttgttcacaatatcaaaagtagaaacaacccagatattcatcaactggtagatagataaatagatagatagatagatagatagatagatagatagatagatagagtgtagtctatccatacaatgggataacattgagccataaaaagaaacgaagtacagacatactaccccatcaatgaatcttaaaaattatactatgtaaaagaagtcagacacaaaaagtcacatatatggtttcatttatatgaaatatttagaatagataaatccatagcaacagaaagcagcctaatcctttctctagaggctgggcattgaagggtttgttaatgggttcagggtttcgtattttatggtgatgaaaatgttttggaactaaatagatgtaatggttgcacaacattgtgaatgtactaaatactgcccgattgtacattttaaagtggttaattctacattatgtaaattgtatctcaatttttttaaaaattgaggaagggccaggtgcaatggctcatgcctgtaatcccagcactttgggaggccaaggcgggcggatcacctgaggtcaggagtttgagaccagcctggccaacatggtgaaaccctcgtctctactaaaaatgcaaagttagttgcgcatggtggcaggcacctgctactcaggaggctgagacaggagaatcgcctgaacctgggaggcagaggttgcaatcagccgagatcataccactgcactccagctgggcagcagagccagactgtgcctcaaaaaaaaaaaaaattgaggaaggaaccatgtgaaattctgtgcacctcctacttgagttggatacctggtcagtggtagcaaactaagcaagctatttccattgacaaatacaaataaatccttccttcattgtcttcctcaaataaaatcccttgccaatataggcaaggtattttcattctcatgaaactgtggctttgaaatgtgtaaatatctcccttgtttgtaatgaagtggtcagtctcgttctgtttgtgggcaatatgattgaagtctgtctcaaaggagtagtcaaacattaacagaccgtgatccaaattaaactatgaaatgtgttcttgtttatcccatgccagactcttaaaaacggttgttagttaaaattgaggtttcaaaaaatgcagtcttctggattatctagggagggggcagaattctgacaatctgtgacccatagtattgttactatatggtaacaatcacctgagattgacagcaggtgcccccttgagacgccatagattctctgtcccttttctcccatatgtattaccagtcaggttattcactcttcttcctgaccccacccccatatcaccacaactgaacagaaattcaacttttagactctgattcaaagacattgtttgcaaagtctcctattaaaatataaatgtgccatctggaagaagagggcagaaatccttagtgcaaccatttttttccatagtcgaacaggagggtgttggtaaggatctcttaatttgtgggtgggattgaggcagagggaaaaagcccagataaaatatcaccagcttggggtggtcgtggtggctcacacctgtaatcccagcacttcgggaggccaaggtgggaggaccacttgagcccaggagtttgaaaccagcctgggcagcatggtgaggctgtgtctttacaaaaaattaaagaattggccaggtacggtggctcacacctgtaatcccagcactttgggaggccaaggtgggaggaccgcttgagcccaggagtttgaaaccagcctgggcagcatggtgaggctgtgtctttacaaaaaattaaagaattggccaggtacggtggctcacacctgtaatcccagcattttgggaggccaaggcaggcggatcacgaggtcaggagatcgagaccatcctggccaacatagtgaaaccccgtctctactaaaaatacaaaaaagtaggccggcatggtggcaggcacctgtagtcccagctacttgggaggctgaggcaggagaatggcgtgaacccgggaggtggagcttgcagtgagtcgagattgtaccactgcactccagcctgggtgacagagcgagattctgtctcaaaaaaaaaaaaaaaaattaaagaattaactgggtgtggtggcacacacctgtagtcccagttattcaggagcctgaggtgggaggttcacttgagcccacgaggttgaggctgcagtgagccagagttgtgccactgcactccagcctgggcaacagagtaagaccgtgtctcaaatatatatatatatatatccagtcttgtcacaatatcccagcctgaagggagtggctggtggcagactggatgggagagcacaaaacaggcacgggcttctcctcccctttggtactgccacctgctttttcaatttcacagtcttccctgaggcagtcctcccttctctgcctgggctttatggctagtttttgaatgcttttgcctcctggagtacctcatcatacaagtccaagtaaggctgaattccaaaaatcccaactctcagaatcctgccaggtggtcacaatagcacccttgtttttatgtaacctagcacccatgggacctggcttttatttttgtttttacttatttttctccccctaaatgcaatatggaaagaaccaaggagttgaggactattatcccagtttctggaagttcagttttctcctctaaaatggaaagggactctccaaaatcaggtaataactaatcgagaggcagaaagatagtaagagtggcccagggtttcttgtgactgttcctgcccccacacaaaattcctgcaccttgtggcctttcttagactagagtgaagtgtgtttccattgttaaagatggttccaggtggcagctaatggcagctgtccaaagctctaagggcaactgtgatcttgatctgatccaacttttaattgagcttgctttgttcttttgattttcagtgggcatgtgtggcctcatctctgagctattgtttcatcaggcattgcagtaaactttgaagaatgcaaattctgaacttcatttgctgtcacctggaaggtgctagacaaattcaatccccttgaattctgtgactagaacctataagaaaaaatgaattgtcgttttgtaggttttcatagagaagtagcaatagggaatgatgggtgaatttggacaagtcactttatcccaaagcgtccatttactcttctgtgaaatactactttatagtgttgtttggcctaaattaaacaaaccatgcaaaaagcccagccctgtgcctggcatacagtgagtgctcatgtgtttgctgctattatattctcctaatccagtttgaaagctgtgaggcagcaactttccaggaaaagatggcttcagccaagggtatgttcctaggacctaccctaaagttagtctctcctattagagtagtttgaagctgaacttggctgaaaactataagaaaggctggtttaggggaagcctttgttacttttagtttcttgagatctcttcttgacctaactcttcaatgctcaccacgtgtcatccattctccagcactgtttctgtgtacctgactgacagtttgcctcacagtaaaatgattcctctgggctccctaggtgaaaggatgttgggcatagcaagttgtaatgctgttgatctcagaaatccttccgatgctccaaaaaataaagcaatgagcaagacatgtctagccagcaggaaatatccttcatacaaaatggttaatttctaaaacctgtggcatcaccttgacagatctcttctgtttggtttatacgggggaatccaactggaagagtccttcctgacccttggtctgcctgggcagaggaggtactgtcctctgaccatcagattatgttgggtctagcaggctgccttcttccaggctttgtgcaccaacattaaaaaggcagtcatttctcaaaattgtttgggaaatgattaacttgtttcctttgatcctccctgctctgtgtgaggacagtcaagtagcagaggtggagaatgtgttctattattttcaacagtgctaagtaaacactgggggaaattctgccactagagaggtacaactgtgtttgagggtttgaaggcgtgcgcgcgtgtgtgtgtgtatgtgtgtgtgtgtgtccttctgaaaacatagagctattgagtacaaaaatatggccatttcctctaaattttctttcccctgttttttttttaaggtctgaatttcctgctgctgttcacaaagatgctttttatctttaactttttgttttccccacttccgaccccggcgttgatctgcatcctgacatttggagctgccatcttcttgtggctgatcaccagacctcaacccgtcttacctcttcttgacctgaacaatcagtctgtgggaattgaggtaatttaccagtcatccttttagtttgtcaaccttcctcaaactcaaactgtaactccaaacctagggatagctcatgaaggggattgggtgcagcatgggaaagtaaagctttcatgttaccaatcaacaggcaatatacaaatttaaacttctattactggcacattttcttttgtaataaggacagttgtatgatgtcagtaatctagattggagttggcaaacatagccatgaacaaaatccatctttttttgtgcatctggcaagtaaagaatagtttttaccttttttaagggatgagttaaaaacaaaaatgggaaagatgaggcatgtcccacaaagcctaaagtgtttgctgtctagccctttgcagaagtagtttgacaacccatgatctaaataatagtgtcagaactttggggacaggatgacattttcattgagatacccagtgtctgagaacaattaagccatttcctccagttaaattctagtttgagttaaatttatttttcttaacactataaaaattgaattaggctcactcccccgactttcagcaaattccccagcttcctgtatctatgagcaaattgaaagttccaagaatgttctcttcgtttatccttccttctgcgcccatgaatatcttcatctgttttcatcttctaccctcttcagagaaaaaagcattcctgttccttcacaaggctaatttcttctgttgtttttacagtcttctctttccaggatagaaggaatcttactccaagctacctctactctccagctcctctcccacctgtgggtacatctgcatgttcaatgtcttcactgacatcttcccgtcctgctgcattccaccaccacctctcatgcctttcctttcccaccagagttctttgagagtagtttgcttatcgatttcctcttctgaacttcaacccactgagatctgaccttttaccactaccatctcctccaaagtgctctgaatcactcataacctaacttctaaattcagtgacttctctttcagctttcctctcaattgacttgagacttctttcttgaaactcctcctttcgccttttataatatcattccatgagatttcttcctaatttcaaaacaatctttctttgttctttcctctcttcataatagggttttattctcagcatctcttgattcctctgcagcaggggttggcaaacatatgctgtaaaggccaggcagtaaatggcatagaatttgcagaccacatgggctcttttgcaacgactcaatgctgctgttgtagaataagagtacagtaccagacaacatgtaaacaaatgagcatgactgtgttccgataaaagtttacttacaaaggcaggtggtaggccagattcagcctgcagattatagtctaccaaaccctcatctaaattctcacagctaagaaaatacctcctcttttatgacttgaaaatgtgcctaagtctgtgacactgaaatctgattttctattctgacctcagtgatgcttaagtaacttaagctctccatgtcttttcatgcatgttttctcccttcacacacacacacacacacacccctcctttcctattctatttcagttaaatgtatctcttcttacccagttgccaaagttaatagtctgaaacatcttggattcttccttcttccttgactaggcacttaaacagacagcaagaccctgtcttccttcactagacaaggaactttatttttgctattttctgtcttaacgtgatggcccatgtaaattttccctgatgtcctagactaagtcagatctcttgttacatcctcgtgtgttttcctgtacttttatagctctcactttggatactaatttacattgttgaatgcttatttaattgttgcctgttcttctctacacgaaacttcatgagagttggaccactggaccacacccgcagcacctgttgtagctccagggtccatcccagggccctgatcctgtagatccagctgacatttcagatagattcctagctactccctttttctttttttttttttttttagaggaagtctcgctcttgtcccccaggttggagtgcaaatggtgtgatcttggctcactgcaacctccgcttcccaggttcaagcgattctcctgcctcagcctctcgagtagctgggattacaggtgcctgccaccacacccagctaatttttgtatttttaatagagagagggtttcaccatgttggccaggttggtctcgaactcctgacctcagatgatccacctgccttggcctctcaaagtgctgaaattacaggcgtgagccacagcgcccagccagctaaccccctttttcttgaatacgccgtcctctagctgcccacccaactctgcgctgcgttttcttacctccatgcctttgctcaggctgttcctccactctggaattttcttttttctcctttaccctacccaaatcatatcttttgccaaatgcctacttgtcttcaaagtctgtattgaaataccatttcttctctgtaatctttctgcttaatacagaactggttgcttcatccccaccactaatccatttcctccaaattcattatagcatgtacatcatagtattatatttgcattttttccttatgacctacccatactccaacaaccgtagtgtgtgaggtgcttaagggcagctattttgtcttaactcacatctacagtatgtacagagtacctagaacacatagtatgcattcagtagaagtttaaactcgataagataaaaaagatataaaactatacatatcatctctcctccatatatatacacacatggatgccaggagggttaccaaaaacataacagtggcaatctctgggtgggattacagatccacttttcttttttttttttttttttttttttttttttttttttttttttgagacggagtctcgctctgtcgcccaggctggagtgcagtggcgcaatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccacagatccacttttcttaagcctttattacacttttgtattttcttttttttttttctgagacggagtctcactccgttgcccaggctggagtgcagtggcgcgatcttgcctcactgcaacctctgcctccccggttcaagccattctcctgtctcaacctcccaagtagctgggactacaggcatctgccgccatgcctggctaatttttgtatttttagtagagacggggtttcatcctgttggtcaggctggtctcgaactcctgacctcaggtgatccacccgcctcagcctcccaaagtgctgggattacaggcgtgagccaccgagcccagccactttcctattttctaaaatgtctacgatgtaaacatactatgatttggggatttttaaaaatcaattgactagcgaagagaacattcccgtgacctcaaaatcggcatttatggtctctttaattcaattcataaaggttttggaaagagtgaggggagacttgaacttggcctaaacttggtcttgtgtcttagggaggagcacggaagggggtttcccagaagaacaatgacctaacaagttgctgcttctcagatgccaagactatgtatgaggttttccaaagaggactcgctgtgtctggtaagcctggtggtctgtccttgcctgaagaagacaaggtgaggtctgtggcccatctctctttctctgtctcacttctaaaaccccagctatttagatgcagtgatccaagtagaatcgcaacatgcaaaatagaggcaacattagaacatagtattaggatgggcgttggaaccagtgtcagacggacttaggtttgaaacctggttcttccatttccagcttcataaccttgtgcagaccactttgcttctctgaatctgtttctcaacacaagaagaacgtccctgccaaaactgttgttaaagggtcaaggagataataatataggacagtatctttaactcactagtacctcatatttgtttagaaacatgcctttcattaatgtaattccctgcatttacagatagacaatctgagccaggactagcagtccaggattcctgatgtcttaccttgtccttaactctgataccatcctactgaccaaagttagcacttctttggacttttttagagactaccaaatgggctttgacacgttcatttggaatacatcaagccttaatatttatatcttatatcattgaacataatgcctggcacacacacgtttacttttaaaagctgctggcttatagctctttctgtgcctttggtcttttgggtgacattctggccgtgtaacttttatccgtcccttgacttctgcatgttaactaagactaagagcatattcatagccaactcctgtcaagtgttaactatacaatagctactgcacatatattacttcatcttccctaaaccatagagagtggttactatcactgccatttttaaagatgaggacccagactcacagcttcaagaccattaccaaggtcatagaactagaaaatgtcagagctgataggaaaatctaagtgtgtctgtttgacttggttgttctattttaggttagctcgtaagtgttttataaaagtagtcactcctccagacaatgaaagatttattgtcaagaaaacatctatctgaagagtccgatggggcctgtacttagtatatctggctccaaatcagcatttacttatagacttcatgcaaataacaaataaaaacaaaccaaacatcagtttctttacttctctggcaatttaagatagtatatgtctaatacagtataatttcctttggggttttttccttttttttcagagacgggatcttgctctgtcacccaggctagagtgcagtggtgtgatagaatatagctcactacaactttaaattcttggactcaagcaatcctctcacctcagcttcccaagtagctaggactacaggcatgtgctgccacacctggctaatttttttttcctttttttcttttctttttttttttttttttttttgagatggagtctcgctctgttgcccaggctggagtgcagtggtgcaatcttggctcacggcaacctctgcctcccaggttcaagcaattctctgcctcagcctcccgagtagctgggattacaggcacctgccaccatgcttggctgatttttgtatttttagtagagatggggtttcaccatcttggccaggctggtcctaaactcctgacctggtgatccacccaccttgacctcccaaagtgctgggattacaggtgtgagccaccatgcccggcctacacctggttaatttttttaattttttgtagagacaaggtctcactatgttgtccaagctagtctcaaactgacttcaagagataaccccctccccgactccagcctcccaaagtactgggattacaggagtgggccactatgctcagctctagtgattttctgtttttagaagttttctttattgaggatgtgttgttattgtgactaaaacaagccatttagcaagtgatatgtggcacatgagagatataatttaggatttttttttaaatactaaatcctaaaccaataccgttgaaatagcttctcatggaagcaggcgtgagaaatctggtgtggctacttacatagaaaaatgatagccaggcatggtggtggtgcctgtaatcccagccacttgggaggctgaggcaggagaatcgcttgaacctgggaagtggaggttgcagtgagccgagatcgcgccactgcacttcagcctgggtaacagagggacactccatctcaaaaaaataaaaaaagaaaaatgacacttctggtcctatctggggttgcatacattagccttagctagtagtttgtttatcttgagactcacttggggctactgtttaaaatatatatcttctggttacaccttaggttcactgaattaaatttccagataatgaaacctaaaaatcctcaggaagctttgtatttttagcaacacttccaggggattctgtataccagagttggaattctacttagtttagagggacaactttgccaagaatttgttaatggatgggctctttgtagatggccacagcttagaacagaacaggtctgagttgactaagttaatgaaaggctaggctgttgcctggtcaggcatttggctagtaggctgaagctgatcaagtcacagagtttaatgagacctgagttgttgcccctttgggctaattatttgacttattccttagacaccagcctctgctagcatttttatcaatcaagaggtgataagatgcagtataattccttcctggaactctctctctcctttctttctttctttttctttctttctctttctttctttctttctttctttctttctttctttctttctttctttctttcttccttccttccttcctttctttctttctttttctttctttccttctttctttctttccttttctttctttctttccttctttccttcctcccaccttctctttctttctctctctctctctctctctccttctgtctttctttcttcagggtctggctctgttgcccaggctggagtgcagtggcacgatctaagctcactgcaacctccacctcctgggctcaagccattcttccacctcagtctcccaaatagctgggactacaggctcatgccaccacccatagctaatttttttatattttttatagagatggagttttgccatgttgcccaggctggtcttgaactcttgagctcaagtgatctgccaacctctgcctcccaaactgctgggattacaggcatgagccactgtgcccagcccccagtatactttcttagacattcatcagctctaccacttgctgagtgagcttaaccaagctgtctcagtccttcataattcttagtacaatacaaatgataatagctgggaagatgagttaatgtgcctggcatggagtaagcatttaataaatggtagctatcattagtgattaatgttagtacaaatgatctcaatgttagaccacccaagacacacaccctgggggagcaagtggcttccactctgacaaagccatgcttcagggaaagttagtctgagacgttacttctaaggctttcatgcagctgtttcaattggaagcaaaagtactaatgttttctgtacacagcctcctcattcatttttatatctctttaatcagagtgggtatctcttccctgctttccttcctttttttcccatctcttagtctagaagtccacttacttgcctccgaattcctagtaactctctttctgaataattccttttggcaagacctgaattcctcttagcagtttgactagatcctctctatacattttcctgcccttctacttgtctacttataacaacctccttctggcttagacgtgagggcttctaagccacttagtgtgttcttcagcctaataccactacttccttgacttagctttaaaagctgagatgccatttattcttgtaaatggatgttcccaaacttattttaagtaaggctgagtagtttagatattcagaagtttaattcttttattgtcaaatgcaagatgtaaattggaaaaatactgaagacaaatgcatgagtgtgtgcacacctctgtgtgtgtttccgtgtttttttacaagccttgatatcttagaagatactctcatacaaatgggcaaagtacatgaacaaacaagtcatgaaagtaaataaaacctaacaaggaaaaaggtcccactttactagctgttaaagaaacttagactatagtaataacttttcaaacctatcaaacctgaaaatattttcgttttgttttgttttgagactgagttttgctcttgttgcccaggctggagtgcaatggcacgatctcaactcatcgcaacttccacctcccgggtgaagcaattctcctgcctcagcctccccagtagctggaattacaggcatgtgctgctgcacccagctaattttgtatttttagtagagacggggtttctccatgttgggcaggctggtcttgaactcccaacctcaggtgatctgcccgccttggcctcccaaagtgctgggattacaggcatgagccactgcgcccagccttgaagaaagtttttaaagacactatttagcagtctaggagagtgtgttaaaacttgatatgataggagaaaagtgaattgtcacatctgctccagtaagcagtgtggtctaggtatcaaaagcctgactgttctgagcccctattcccttcccttattatattttaggggctctattctaaggaaatggtctaaatttaaaaggatcaatttgaaaatatttagcgtaatttaaagtgtcaagcttgaaaacaatctaaatacccacgatgaaataaagtcaactataatagaacccttcatcgactggccattgaaaccactacagagaagagataatgacatgaaaatacttaggtcagattgggagaggaagcaaggtatcaaagtattatattcattctatacatggggaatgaacataactgtcaaactatgcaaaagggccatgggataatatatcagtgttaataatggtatttgggtgatgagattgatgattcatattttaacttttttatatctttatgagcatagtttttattgtagggaagttcaatccaagattgttcaatacaggctgtttgtgtttacttgtaggctttcacttggtcatgttttgtgggctaaccccatatggatggctttctctgaatgtctacattatcatggaggttacatattcaacactgaaccactcctgttttgtgtagcatttcctaaatgtttcaactatagtttataggactcttcatttttgaggactcagtgctttctgactttgaatttcctggacatataatagaagctcaaatccttgttggacttaccctttgtgtcttgccccttcttaatctccttttagcttccttggtccagagaatttgcaactggagttgattttcttttaatattatgtttttagacaatgggccctgcttgggatatagaaaaccaaaccagccctacagatggctatcttacaaacaggtaagttgagtccatgtttttagacagattctttctaacatagtattctgaactacaggatacgatattggtcagtttttggtcttgacctcttctctctctctctcaccccatctctcttttttgtaggtgtctgatagagcagagtacctgggttcctgtctcttgcataaaggttataaatcatcaccagaccagtttgtcggcatctttgctcagaataggccagaggtaactatgttgaagttaactaaaggaaatgagtcagggttaagtttaaaaacttcaaatgctattccccgtccagcattccaacacttgttaatgccttaccaaagctattgttaaaattttctaatgcttattctacttgaaagagttaccactcagaacctatttaatttctggttaagtgtctggcactctcacctaggtgtttggacttctcttttttctcagcctatcatgtgttttttgaagtcagtctgattgttacatgaggaaaataaggaagctaggagggaccgccaaataagatcttgaagatattgtggaaagtatgtattagtattagaactgaaacttgcaatttgtaattgaactagtaaattcagccattcattgctactgagtctggccatagctatctttccacagtgagttggaagcagattttagacagtaagatgacagaatcaagcttatctccaagttttggttaagtcattaggcacattatccccagaggaagtctttttatgcttcaaacgctccctagaaatgcagcatatgatacatataacatacaaaatctgtgttaactgtctgtgttatcagcaaggcttccagtcgacagaagccattagtagttaagttttgggggagttaagttctatgtggatcttgttgaaagttcacaaactgtaagtcccatttctaatgctaatacaaatataaaaatattcaccaacatttttaggtgaatctgcatactccattcttgtcacagtcagcctcaatagaaaaaggttcccttgactctagtttaggaacttaacacctaatctgatacagttaatccttgaacaacatgggggttaggaccactgcctattcagtaaaaaaatccacagataacccccccaaaacttaactactaatagccttcctttatgataatataggtagttgattaacacatattttgtatgttatatgtattgtatactgctttcttacaatatagtaagctagagaaacaaaaatgtcattaagaaaatgataaggaagagaaaatgtatatactattcattaggtggaagtggatcattataaaggtcttcatctgagtcatctttaccttgagtgggttgaggaggagggagaagagaggttggtcttgctgtctcagacctggcagaggtggaagaggtagaggagatggaaagagaggcaggaaatataggcaccctcaatgtaacttttattgaaaaaaaaaatccacaagcagacccttacagttcaaacccatgtgttcaaggagcaactgtatattagtctgctagaactgccataatctaatacacagaccatgtggcttaaacaacagaaatttattttctcacagttctggagtctaggaatccaaggtcagagtgtcagcaggtttagcttctcccgaggcctctctccttgacttgtagacagccactttttcattttgtcttcacacggccttttctctgtgcacatgtatccctcatgaccgttcttcttcatagaaggaagggattaggaccccacacttaaaacttcatttaaccttaattacttatttaaaagccctatctcatatactgtcacattggggattagggtttcaacatgaatttgggttgggccggaggaggggtgacagggagacaggattcagtccataacatctacattgatatttaaggcccatcactagcagattcctacctacctttccagttttatttcctgtagtcttcaagcttgctaatgtgtatccacacaatgatgttatgctgtctgtattagttcgttatcacactgttacgaagaaatacctgagactgggtaatttataaaggaaagaggtttaattgactcacagttctgcagtgctggggaggcctcaagaaacttacaatcatggcggaagggaaagcaaacatgtccttcttcacatggtggcaggaaagaaaagaatgagagcaaagggggtggaaagccccttatgaaatcagatcacatgagaactcactcactgtcacgagaacaatgtattagtctgtttttatgctgctgataaagacatacctaagacctggaagaagaggaggtttaattggacttacagttccacatggctggtgaggcctcagaatcatggtaggaggcaaaaggcacttcttacatcgtggcagcaagagaaaatgaggaagaagcaaaaagtggaaacccctggtaaacccatcagatctcatgggacttatttactatcatgagaatagcacaggaaagaccagcacccatgattgaattacctccccctgggtccctcccacaacacatgggaattctgggagatacaattcaagttgagattttattttatttatttatttatttattttttgtgagacggagtttcactctgttgccaggctggagtacagtggtgccatctcagctcactgcaacctccacctcccgggttcaagcaattcttctgcctcagcctcccgagtagctgggattacaggcacatgccaccacgcccagctaatttttgtatttttagtagagacaggatttcaccatgttggccaggatggtctcaatctcttgacctcgtgatcttcccatctcagcctcccaaagtgctgggattacaggcatgaaccactgcacccggcctcaagttgagatttgaatgggtacgcagctaaaccacgtcaaacagtatgagggtaaccacccccatgattcaattacctcccactgggttcctcccacgacacatggggattatgggaactacaattcaagatgagatctggatggggacacagccaaaccatatcactattctttgttcattcacttccttcttttaatctacctctacctccataaccaaatcctactagtcctctaaagccctgcccagttttcatcagtttcccacaagcagtcccaaatagctttcctcacccttgaaagtgatctctgacaccctaaggctcctaatgccttccatacctcttacggatggaacttatcacactctgcctttgtattctggtctacctttgtattgcagttgtccctgtgcctttcttatctcccttatttaattgtactttatagcagtatttacaactgtccctatggccccacagtgatttttttttttacataaaagtcaacaaataagtaatcccagcactttgggaggcccaggtaggcagataggttgagcctaggagttttatgccagaatgggaaacatggtgaaatcccgtctctacaaaaaatacaaaaattagcttgacatagtgatgtgtgcctgtagttccagctactcaggaggctgaggtgggaggattgcttgatcctggaaggttgaggctgcagtgagctatgatcacaccactgcactccagcctgggcagcagagtgaggcactgtctcaaaaaaaaaaaaaaaagcaaaacaaaacaagacaaaaaaccagacagcatttgttggctgaatgactgaactggtactcttcagtgtgccctccagtccttacttgaacttctctctgtacagtggatcatctccgaattggcttgttacacgtactctatggtagctgtacctctgtatgacaccttgggaccagaagccatcgtacatattgtcaacaagggtaaaattttgctgttacattacaacttgattctttctcaatgctgagtatttcttcaatttctgcttttttgtttatttgtttgtttgtttaagcaaacttgaaatgctgtggtcggaaaatgttcaagtctttctagttttgtagtacttaggatataattttcaggaaagctacaaaaagcccatgaagcagagatacacacagaaagaagtttcaatgacatgcgtcagggtgacatggtatgatgatatagagacaagactactcactctgaacacactagataaaagcccagagagtgagcttaattgacttaatcacagtaaagctacagatttaatttcctacctttgtaaatccaagtcaatacagttaaccagcatgtaccaatgtccatggtgagtctgcagaaaataattgtcgttgttagagaaacaagtccaaatttgatgggcaagtaacagccctttcacatatccaacatgttaccttctgtcatgggactagtagattaagtgagtaagtccatttgcacagtaaacatcatttgaaactttaaacatgcatcaaagcaaatgctaaaatttagaattgtaaaatacttgtcagctaaaaatcctatttgcccccttctttttcttctattccctactatcctcctcaaataaaacagtgatagaaccacacctcagtaacctgtttaggttatctgaatgacttcttaagcagaaggaattctgtggttcctctagaaactgtaaaatctgctggcacagttcaagaacatgtgcttctgtttcagttaagttcatttatcatcaatggaatgtttcaggttgtacattataaatctgatttgcaggtgtaatctcctttggacacctgttagctttgaaaacttttaaaacctcttccttcttgcaaggcaatcaggtacttagcagagagagggaatgacctctggttctattttggcttccagctgatatcgccatggtgatctgtgacacaccccaaaaggcattggtgctgatagggaatgtagagaaaggcttcaccccgagcctgaaggtgatcatccttatggacccctttgatgatgacctgaagcaaagaggggagaagagtggaattgagatcttatccctatatgatgctgaggtatggatctgaaatttagcttgcagctccaatgcttgtccaacaccttgggcaacttgcaagataccttcccaagaggacagtgttcttgttctccaggggtggcacgtgaggagtagattagactcatgctgtgaagctctgagaataatttccacaagacaactttgaaactcatgccaggagaggacaaagttctgtggccagctgtatggacttctaagtggataatatataaataggggtttagtaatagttaaaggatgtggctcctggagccaggctgcttgggttcgcatgccagctccacatctgttaggcaaccttgggcaatctcatctcccttctctcggtccgtaaaatggtgataaaaataatcactacctcacagaggtcttgtaaagagttagcttaattcatatatgtagatttctcaggacagtgatggatatgtaataagctctgaaaatgttagctattcatttctttcaaaaaagatttagttagggccctagatgactgaaacttaagagtacaatgggaagtttgaacatgcaatctaccctctataggtagatgattttctagagaaatcttatgctcttccctggggcttccattgttcctgaatgttggcttctggtcctgatccaggttggaattttgcttatattcccatagagatgttctcacgggaaagggagggagagggccacatttatcacagtctgtccatctcaactaatgtctttctttcttggttttccattcacatagaacctaggcaaagagcacttcagaaaacctgtggtaagttttcttctgcctgaatttgagccttgccatagtcaactctcaaagttcatggtggaataagcccttgtgcttcctcctccagcctcctagcccagaagacctgagcgtcatctgcttcaccagtgggaccacaggtctgtgcccatgaaactgaaccttagacccctggtcagccaagaacatggcttcaattcttggccactggtaggctggtaaatactccctctaaagagccctatacttaggggctcacagcctaaggcttctaagtgtgaattcccaaatggaaaaacataaacataagtaaatacactttatttaatatattgggaggtgtttatattcaatagatttcaggggtcttaaagatgatgtcagaaagtcctttcccccgcccccaccaacccaccactctcttgatttgacaccgctggaatggtttcattcaatcaagataactcagtgatagttctccataaagggcttcaaccccaccctacatccacccatctgttagaatgcttaatagtttttaatgtggtccatcatggtctacagttatattctttctagtatgcccagtttataaggtttataaccatatcactatataatattggtagatctggaattccaaacatataaacagcatgagatgtggggcagagggacaaggagggttaacttgaatttttctttgcagctgtgcttctatctgaaatcatggctgtgctctgcatagtagtagaaggccaacgatgcattcagcagtagaatctccgggggcattaattattcctaaacagaggcatataccatccacaaaaagacacagtgacaggaaatgctcttggccttctggaataaaaccaattgaatctagtttctttcaaggccaaaggctacctattagctacataaagtatctttctctccacctcttatttcctacaggtgaccccaaaggagccatgataacccatcaaaatattgtttcaaatgctgctgcctttctcaaatgtgtggaggtcagtggtcagttgaaaaagaggctctcattaaaatgtgaatctgtcataagatttttatttttgaggttagagcaggcagacacacacacacacatacacacacacacacacacacgttaaaggctggagtgtggacaaacaccagcgtgttctttgtttagaggactgtacattttcaagcgttggtcttttaggatcactgcaaatttctacactatatgcagttcaaggcatctcagatctacacagtgtaccgcctatacagctgtctgtggtagtcctgggaggaggtagttttaaaatctccattggaattgaaagttggcattaatctcatgttgcctcctcttacttccctggcctacatagcatgcttatgagcccactcctgatgatgtggccatatcctacctccctctggctcatatgtttgagaggattgtacaggtgagtgttctgtgttcctagcagtatgtggcaagggggtcctgacttgctatcacatgtttattccaaaggcagctacacagtatttactgttctttctccggtgtgagaggtgcaggcaaggagttggctcatgggagccctaatcatggcatggcccctcatttcctgcagagtcttcctctgctaagtctgcatgtgtccagggaggatagtacttgctcctgccttcatgggggtgtgtgagtctagtgacatcacagctaggagcttactatctatctgcccttaattctgagctgacacaagacattgtcttctttttaaattttattttggttagaatttttgaaaagatctaggattagagaaaaggaagttccctacagaggatcagggaaggagcatttgatctacataaggtgtgagatgtcccccgcgccggtttttgcacacctgagtgtgtaaggtggtgctgtcagcatggtgcataccggaggaggtctgctcttctgtgagtggactccaggcttttcaggctattttgaggctgatttgagaaccaagagccatgtcagcctttcaaaaacgcaggtagtgtggttggaaagttctctctctgctcctcgctacccccaaatgcctcttcaacaagctcatggttgatgcctaaaatgccaaaatgcaagattcagttctttgggctaaagtaatgatatctgattcataaaaaaattgattctaagaaatcttaaaaaatattttaacataatttatgaaattgtgatggtcttacgattgaaggcaggttctgctttaattggcagtgctttcttagtgccacataatgaattgcgtcttacaaaggatgattatcttagactgtcacacagacctgtggtggagtctgggggaccacacagtctcaatatctgtcttatctgtcatgccaccacaacagaaataaatgtccatcctttcttgggggaaggttctcagagtcctgaattgggagggaggtgctgtgcaagaaaagtgtctgtgtgcctcagcccacttcccaaattccttccaagacaggtccccactgaaggggttgtttgcctcagcccacctcctgaattccttccaagacaggtccccactaaaggggttgtttgcctctaagctctataatttggttttgttttcaggctgttgtgtacagctgtggagccagagttggattcttccaaggggatattcggttgctggctgacgacatgaagactttgaagcccacattgtttcccgcggtgcctcgactccttaacaggatctacgataaggtactaactttcagctgaagggactgtctgtgacttgggcctgcacgaaggaactctgtactactatgagatttactccacctctacctccaccctctacaagtatctacgtaaagccgtgtgtaaatacaatccccgccaggtgtggtggctcacttctgtgatctcagcactttgggaggccaaggcaggcagattgcctgaggtcaggagttcgagaccaacctggccaacatggtgaaaccctgtatctactaaaaatacaaaaattagctggactggtggggagcacctgggatctcagctacttgggagactgaggcaggagaattgcttgaacccgggaggcggaggttgcagtgagccaagatcacaccactgcactccagcctgggcaacagagcaagactccatctcaaaaaataaataaaaataaaattaaaaaatgaaaaataaataagtgcaatccccttttccttggataagatgacttggacctgatctgaagaaagcttgactaagagacttggggggcccctcagggttcagcagacatcttgggaagttgttccctttctgaagtgccaggccccatgatatacatttcagatgcatcctctcattgaatcctcacaaaatcatagtaaatcatacttacacctattatttctaacttatgatgaggaaaatgagcctcagaggttaaataacctgcccagagtcacatctaataaggggtagggcagaattaagctttcagtagtcatgtttcagtagtcatgtcggctagtcatgttgatgactagcactgctctatttttcattagaaattacagaatggtgatttctgtaattctgtcttcctcttgcattcattagctgagattcttccataaaacctggtgaatatttgattctttttatttatcaatcttcagaagaatggatttgtgcctcagcaatcttcaaaagtagccaatgagattttctctttgtatttttaggaattcataattttcagatttttttttaatttcagtgattctttttttttttttttttttttgagacagagtcccactctgtcacccaggctggagtgcaatggcacgatctcagctcactgcaacctccgcctcctgggttcaagtgattctcttgcctcagcctcctgagagctgggattataggcgtgcactaccacacccagctaattttttaatattttttagtagagatggggtttcaccatattggccaggctggtctcgaactcctgacctcaagtgatcaccctacctcagcctcccaaattgttagtctttcttcttgatcttctaactgccccatcgtggcagttgggaaacctcatcaagttgctcatgtgtccttttgacaatacccctgtagcctctgatagcttccttggtttctggcacaagatgtctcaacctcatcttgtatatttctcacccaattcttagagtgtctgattgcttcagggagccgttgaagctatttgaacccaggcaatatagtatgtgatgattcctcgggctgggatccgtgaggaagtaatgcatggccattcttcacatgctttggaaccctcccccacctccccaaccacctccaagattttaactcttcctttcactcttaggactctcagcagatgctaaatgggctctggtgacagggcaggcagtgttctagcagaactgataacaattccagcagtttcttaccatgctacgcaattagtagatttggtggttgttatggtttttgttcatatgttgttgttgttgtacattttttatttttcagagatagttattgtataatataatacctaatacacagttcacttctggaatgtattttttttttgttttgtttttgtttttgagacggagtctcgctctgtcgcccaggctggagtgcagtggcacgatctcggctcactgcaagctccacctcccgggttcgtgccattctcctgcctcagcctcctgagtagctgggactacaggtgcccaccaccacgaccggctaattttttgtatttttagtagagacgggttttcaccgtgttagccaggatggtctcgatctccctggaatgtatttttaaaatgaaggactttattagcacacgtctctaatactagctctttgtcagtgacttgttgagggagggtgagtcttgtgaatgttgaagaaagataaatctcttttagttgagggagattctaagaatggcatgatgcaggaagcatttgagcatggatcttggagacagattatgacatactggtacaatgataatgttataggcataagaagatgcttatgtcctagagcacaatttacattagaagatgaaaattatcacccctgcttggctggaggcccaaaaatggggttataaacatggaagatggatggagagggattcttcaaattttgaacaagaaaaaagacttcaattgccttgaatctgacttccagtagggtggaatcttgaaagccagataagagttcaggactaaattttggaaataaggggtcactttgagctgtacttggggaagctctcctttggcaggagtgtggttgatggaatgtagggtcacagtgaggtcagagtcagggagaccagggaaatcatgcgagctggaaaaatggtgtcagaattaagcccaaagggaagaaatcattttagtaggaaggtaggaaactctgttggggtttgtatggtgtggctaaagacaccttgtttatagggaagggtgggaattctccaagttcagttatataagcattacagagggagagggaggaagacatgatacttgttttaaaaaatcagattcctgggccgggcgtggtggctcacgcctgtaatcccagcactttgggaggccaaggcgggcagatcacgaggtcaggagattgagaccatcctggctaacatggtgaaaccctgtctctactaaaaatacaaaaagctagctgggcgtggtggcgggtgcctgtagtcccagctactcaggaggctgaggcaggagaatggcgtgaacctgggaggtggagcttgcagtgagccgagatggcgccactgcactccagcctgggcgacagagcgagactctgtctcaaaaaaaaaaaaaaaaaaaaaaaaatcagattcgtaggctgccctttgacctactaaatcaaaagccctagaagtggtgcccattgagctgtgttttttgtttgtttgtttgttttaaatctagtaccccccaggtgactttttaggcagtccctctttatctcagttgtcaagttgtttcccaaggactaaaaattggggcaggaagtgggaggactggagctctgcattaagttcacttctttctgagcatggccataattctctgggctcatcattattcagcaatccaattcatgactgtgagactgtgagaccacttccttataaagctagaacacactgtttcttgctcactaatggctttgatgagtatctccaataggtttccaactaaaaggagctatcactctgcaggtacaaaatgaggccaagacacccttgaagaagttcttgttgaagctggctgtttccagtaaattcaaagagcttcaaaagggtatcatcaggcatgatagtttctgggacaagctcatctttgcaaagatccaggtaggttgggcaggtcctggactgaagcaggcaaatacctgggctgccttctgactccttagaccttgcttttcctctgctgcttgagcgtcactttaactagagatcctttcagactttgtgtccactgccttttgagatctttcttgtaccactttactactaaagggagtaggtttaaaaaaaaaaaaaaaagcaggctgagtgtggtggctcacacctgtaatcccagcactttgggaggcctaggtgggtagatcacctgaggtcaggcattcaagaccagcctgaccaacatggtgaaacccagtctctactaaaaatacaaaaattagccgggcgtggtggtgggtgcctgtaatcccagctacatgggaggctgaggcaggataatcgcttgaacccaggaggtggaggttgcagtgaactgagatagcaccactgcactccagcctgggcagtagggccagactctatctcaaaaaaaaaaaaaaaagttttatttaggttctagcactctctcttattttctttggtggtctgttgagattataagcaatttgaggggctgaagaatacaaattatttgagaaatatatggcttctggtcccagctatggatagtgatgacaataatagctaacattttaagtgcttttctacaatccagactgtattctaagtgctttgtaaattaacgtgagaattgatgtcagtttaattctcataacaacgctgcacaggctattatacccactctacagtggaggaaattgaagccaagagaataggttttagtatgtcttttgtttccactgaacaggacagcctgggcggaagggttcgtgtaattgtcactggagctgcccccatgtccacttcagtcatgacattcttccgggcagcaatgggatgtcaggtaagccaagcaccttctttgagaataggctattttacttttgcacaaacaggctcactgtttaaataaaaatgaaaacaactaaaaggtaccaaaatgaaagtcacctaaattctcaaaatccaaagaaaatatccttctaaccatctcttcaggcatctgtgtgtagaaaccttcacataaataaaaccagtgctctaaaacacttgttaatgttgctccttgtcaaataaagctcagcatcattttaatgatttcacagtagtttactgaatgtagttgacccttgaacaatgcaagagttaggattgcctacccccatggcagtcaaaaattcatgtataatacttgactccctagccgggcatggtggctcatgcctgtaatcccagcactttgggaggctgagacgggcggatcacgaggtcaggagatagagaccatcctggctaacaaggtgaaaccctgtctctactaaaaatacaaaaaaattagctgggcgtggtggtgggcgcctgtagtcccagctactcgggaggctgaggcgggagaatggcgtgaacccggcaggtggagcttgcagtgagctgagattgcgccactgcactccagcctgggcaacagagcaagactccatctcaaaaaaataaaaataaaaaaaatacttgactccccaaaaacttaactactagtagactactattgactagaagccttaccaataatgtaattaatcaacacatattttgtatatgtattatatactgtattcttacaataaagtaagctagaaaaaagaaaatgttatttaagaaatcataaggaagagaaaacatatttactattcattaagtggaaatggatcatcataaaggtcttcatcctcactgtcttcatgttgagtaggctgaggaggaagaagaggaggggttggttttgctatctcaggggcagcacagacagaagaaaatccacctatcagtggagctgtgccatacaaacttgtgttgtgcaagggtcaaccgtacccaaataactaatctcctattaatggacacttgagttgcttatgatatttttcattgttataatcaattaataatctagaataaatccacgcaagaagggattattgggtcaaagtaatacacacaatgtatctgtgtgtgtgtgtgtgtgtgtgtgtgtgtaataatgtatattatcaaactttcttccagaaagatcttttttgcacatttctgcaagtatacaaggccttatttgcccatgctcttgccagtgacagactttatcagtcattcagatattagctaatcagataaatgaaaaatcttattacagttttgtttcttttatttacaccaaacatctttctattgcttattgacatgtatattttatccatgaattattctattacttccttatagaaaaacaggcaaaagataatttggtccttttttatatttctaagagttcttcacagagtaatacaggttgagtatctccctatttgaaatgcttgggactaaaagtgttttgaattttgcatttttttccaattttgtaatgtttgcattataaaacagttgagcattctgaatctgaaaatccaaaatctgaaatgctccaaaaagcatttccttggaacatcatgttggcactcaaaaagttttggattttggaacattttggatttcaaacatttggattagaatagtcaacctgtaatattaacttttgtcatgttggaaacatttttcctggtctcatcatttttgccctgtgtattgccatataaaaatttccaatgtttttatagtcaaactaaataatcttttctatttgtaggttttaaactgcttagacaggacttcctaacccccaatatttcataagactgtttcacccttattttctggcaaacttaccattttccattttttccttttaagtctcagttccacctgaaatttgtccaagtgcttggccatgcatattgtctcaattttcacccagatggataattagttcattcattcaaccaaccatgcagagcatgaacaaaacaggcatagacttttcctcatgagtcccctatctgtataaccacaatcaaaagagactccagaatgatgccaaggcctgaggtccttcaaattagcatcctcttagccatttttaatactgtcctttccttaagcccctaaaaccaatagatcagcaggtcctgttgctaactccttcccgaaatgtcttctctaagccttcctctctctcccaactctgcctatcacaggccacaccccccattgcagcagcccttgaacttgtttcctgcccccagcctctctccagtcaagattatcttctataccaaggattggcaaattgtagcactggctaaaactagtctgcagctggtttttattttaaaaatattattcaaatacagctatgtccatccatttatatatggactgtggctgcttttgtgctattttggcagagtcaagttttgagtcagataccagatggctcacaaagtggaaaatatttactatcttggcctgtacagataaagtttgcccacccttgttttatatcatagtgggggctatttcccttaaaaaatactactccccttcttcagttccttcagtgatgctccattgctcagggtcaagttcaattgctattgggttgcacaccacttagtgaataacttacatgttcccacctacttgaaatgctgcattttcttttcttttttttcttttttttttcttttgagatgtagtctcgctcactgtgtcacccaggctggagtgcaatggcacaatctcggcttactgcaacctccgcctcctgggttcaagcaattctcctgccttagcctcctgagtggctggaattacaggcatgtgccaccaggcccggctaatttttgtatttttagtagagatggggtttcaccatgttggtcaggctggtctcgaactcatgacctcaggtgatcctcccgccttggcttcccaaagtgctgggattacaagcatgagccaccatgcctggccaaaatgctgcattttcatataaagttctatgctttggtctatttccagacccttttggtttctgaatggccagaaggcttggtagtaaatactttgcagcttgggtatgagttcaaggttttttgtttgttcgtttgtttgtttgtttgttttttgagacggagtctcgctctgtcacccaggctggagtacaatggcgtgatttcagctcactgcaacctctgcctcccaggttcaagagattctcccacctcagcctctcaagtagctgggattacagacacctgccatcatgcccagctaattttttttgtgtttttgtagagatggggtttcaccatgttggccaggctggtctcaaactcctgatctcaggtgatcctcccgcctcggcctcccaaagtgctgggattacaggcatgagccaccgccccctccaagttcaaggttttaagacactaagtggtctcgaacccttagagaccttgctttcctcgtgtcttgaccatagcacgtggccagctcacactttatcttgagtaagtctaaaagctcttctttggtttcccaggtgtatgaagcttatggtcaaacagaatgcacaggtggctgtacatttacattacctggggactggacatcaggtaagtcctccatctgctgggcaggaggtgccatggttgggagaaaggttctaactgaactaggactttggagtttagataacttcagttctctggactaatgtggcaaatgcaaaattcaagttttgggtccaggcctgcctatcttggctagtctgcattggtgccaggtgatttttcagtcttcctcttctagagtcaattcataaatatcttagaaatgtgcctggaattatcaccatgcaagagtttctcagctaattcagcacggtatgttctaggtcacgttggggtgcccctggcttgcaattacgtgaagctggaagatgtggctgacatgaactactttacagtgaataatgaaggagaggtgggtaggtcatgccctgtggtcagacagtcatggtggggaggtttatatcagaaagagcaaataattgtaagcaaacttggatttggcccctttgagattgttagcaaagaattaagcattctgaacttcactttcctatcccctatagtggagacttagatctggtgctcttcacagtgtagtggaagccatcaaatgatttaaggggagcaggtgtttcataaactgcccacgctgggaggagcagcctttgctattgtcaccgccttgtatgtctgctgtgcaggtctgcatcaagggtacaaacgtgttcaaaggatacctgaaggaccctgagaagacacaggaagccctggacagtgatggctggcttcacacaggagacattggtcgctggctcccggtaggtatatcatcagaactcctggaagtctatgctaatggactgagaagaacaatctgcttatagcaagaggtgcagaaatgcaagtaggttaatcagctgaggcagctggaggggattaggtttgtaccctacctggcttatgacttcctcatactatccagagaagaacatacagactgaggtggtggatcacctgaggtcaggagttcaagaccagcctggccaacatggtgaaactccgtctctactaaaaatacaaaaattagctgggcatggtaacgggcacctgtaatcccacctacttgggaggctgaggcaggagaatcgcttgaacccaggagatagaggttgcagtgagccaagattgtgccactgcactccagcctgggtgacagagactctgtctcaaaaaaaaaaaaaaaagaacatacaattgaaagaatctaggttaagttaaaaaaaggctgggcatggtggctcacacctgtaatcccagcactttgggaggccgaggcgggcggatcacaaggtcaggagatcgagaccatcctggctaacacggtgaaaccccgtctctactaaaaatacaaaaaattagctgggcgtggtggtgggcgcctgtagttccagctactcgggaggctgaggcaggagaatggcttgaacccaggaggcggagcttgcagtgagccaagatcacaccactgcactccagcctgggggacagagcgagtctctgtctcaaaaaaaaaaaaaaaaaaaaaaaaaaaaaaaaaaatatatatatatatatatatataggctggaagtcatgagatttgtgttctggttgcagctcttccatggatcaacaatataaaattctgagaaagtaatttaacgtgtgaataggagctgccaaagctagaaagtctttcttaaaaaaaaatttttatagagatggggtctcgctgagttgaccaggatagactcaaactcctggcctcaagcaatcctcttgccttgacctcccaaagttctgggattgctggtataagctaccacaccagaagtactgccagagtacttttggtattttgatcacactgttacagaagacaccaagatgtagaccagttgaagtgttttcttcttgccttattccttatcgaatatacaaccagcaagcagtaagtcagtgatcctagcactgtttttagacccaaactgaaggtgggattctttaacaggtcaggtagacctgcacatcagagttggcatgggtcccctgcaatggaataaatttgctaccagccagggaaaaattaggtgacttctctaggaaaggggaagggagatgtactactctgtcctttttttttcccccttaacttttcttgaggcagaagttgtggtttgaagccaagtgtggcagctcacgcctataatcctaacactttaggagactgaggagggagaattgtttgaggccaggagtttgagaccagcctgagcaacatagcaagactctgtgtctaccaaaacaaaacaaaacaaaaacccaaaaaactttggtttgataatgccgttggtccacagcttttgcctcttatgagtttcttgggataaatatcctccctattaattcacaggcatatcaaaacaaggaagaaggatttctaaatcaagtgtttgcagaggctagtgtttgtctctcattgaccttcacagcccctttctgtggaagatacagagacatatttttagcatagcttgataattagcagtagttgctattagttttcctaagaagaaaggaaattattgcaagggcagtgatgggatttcccaaaagatcttccctctcaaaagttttgtcttaactatgtgctggggaagtgggaatgtcactagaacttaaaactcctttcttgctcaatcaatatttaagatttaagtgagatttaaggaatgcttgacaatgtaacttttaagaacactggtcctaacgatgcattttattgatttgggtttggtagtatcttgctaatatatttgtttctgtctagtaacagaattaaataacactctaataagcctaggatgtaagcaacagatatgtccccacaccagggttatagaaggctgcaccttattaatcactttcagataatgaacgttaggctgaattgatggctaatttatcaagtcggccttgtgatagttccagtgttggtttagttagtcgccctacttagggtgttagcatgtggattttatttgccatttgtcccaattctacaattcaaatccctaaagacctaagctcctcagaccaattagttcagagaaatgaagctgcaaatgacctttggtggctggtcagagtcctctcagccctgttgctgtcctaacaagcccagtaattgagttgcttgattagcacagtggagctgtttgagcctgctcccggatctaacaaggaggaaaacataacagggagtcaagtggtgggagaactattcaaatcaaatcaaaagtctaaacaaaagacaacacctctatttctgagagttctgaaaatgaactaattggaaattagtgattggaaattgagagctgtgcaatttcttccttggatgaggcatcaatttgcataactccagtagatccaggagactttctctaaggctgcgcattgactctccacatagatatacagtaaagacaggttcttgctgcacgatgcttccctcccctttcaccaaagccaagaaagagaaatgaaagacagctcaaaagtctctggagaaatcagctttagagaagaaagatgactgtgacttcaccactctccccactgatatcatctctgtggctcaaaaatactgatacttttatctgtctcatgtagaatggaactctgaagatcatcgaccgtaaaaagaacattttcaagctggcccaaggagaatacattgcaccagagaagatagaaaatatctacaacaggagtcaaccagtgttacaaatttttgtacacggggagagcttacgggtaatatatcattttaacaatagcccatttcagtcacaaaccatgctggttcttgtagctacaggaaatttgtatagttgggttcagaatgagaagatccaagcttataaaactaaaaaaaaaaaaaaaaatgaagttacattccaaacctcaaataaggcaatttcaatttaaaaaatttcaaaactatgatggacgttgtacacaagtcagtagaattgtttagaatggctatactaaaaggtaatgattcagtaaaaaatgagctccacattgcacttagttcccattccttaaggagttccttaaagctatgtttaagagcagtatgtataaaacaacaaactgttgcaatatatataaagcaacaaacaaaagtttgatcaacaaactgttgttttatacatactatgcttaaacgtagctttaaggaactccttatcccaaaacaacgaactgttttatacacactgtgcttaaatgtagcttttaggggacaaggggagagttgacatggacaagccagaggcgctttaagcttaatgttgaaggatcagatttgaatggaacatctttgtaatgagatattgagtgggaaaatgggattacagttccatggtgttgaaaatatatggtgagaaaagaacactagtactggatttaaggttttggggaaataactattacaatgacataattctgctttatttaactactgggggacatccctacataacttctctcatgcccttgcaccttttatttcctttccatagtcatccttagtaggagtggtggttcctgacacagatgtacttccctcatttgcagccaagcttggggtgaagggctcctttgaggaactgtgccaaaaccaagtaagtcttgcctaggaaagctttatgcacacccatgggcccatcgtggaggagaggatgcctcaccagttcctgcatctgtcacaagtggctgcagcccaaacagactgaatagttttatgggactcggggataggatggagagtttaaaaaataaaactctcttttctatttaaaataatatgttcattgtgggaaaagattgggaaagaagagtaaaaatgctattcagagaaaactgttaacacttagatgtgccttttcttctcagtttttctttcaatattgggcatataatgtgcttgtgcatagttttatattcctgctttcatactgcatggctttgacaggcactttgagttggttcatgcttagcccttcaggctttttgaaacagccatgctttaagtgatgttttgtattcttaggttgtaagggaagccattttagaagacttgcagaaaattgggaaagaaagtggccttaaaacttttgaacaggtgtgtgctaccactgatgttatactggcctcttgtcagaaagttttgtttaaagtttccatctaatgaggtttaaatgtataatttctaaggaattgattttagattttgtgccattaactacaaaatgaccttttgtagttacttgtacagcgccctttttttgctgtttattgtccattctcccttctccctactcattactttcttaaattatgtttgtgggaatgggcatgtgttactgttacctttaccctttcactgcatcaacctcactttcttcacagagcactcagggggctctgcagagaagtccaaatcactaatgagcatggatgtgtgtgtgttcatcttccaggtcaaagccatttttcttcatccagagccattttccattgaaaatgggctcttgacaccaacattgaaagcaaagcgaggagagctttccaaatactttcggacccaaattgacagcctgtatgagcacatccaggattaggataaggtacttaagtacctgccggcccactgtgcactgcttgtgagaaaatggattaaaaactattcttacatttgttttgcctttcctcctatttttttttaacctgttaaactctaaagccatagcttttgttttatattgagacatataatgtgtaaacttagttcccaaataaatcaatcctgtctttcccatcttcgatgttgctaatattaaggcttcagggctacttttatcaacatgcctgtcttcaagatcccagtttatgttctgtgtccttcctcatgatttccaaccttaatactattagtaaccacaagttcaagggtcaaagggaccctctgtgccttcttctttgttttgtgataaacataacttgccaacagtctctatgcttatttacatcttctactgttcaaactaagagatttttaaattctgaaaaactgcttacaattcatgttttctagccactccacaaaccactaaaattttagttttagcctatcactcatgtcaatcatatctatgagacaaatgtctccgatgctcttctgcgtaaattaaattgtgtactgaagggaaaagtttgatcataccaaacatttcctaaactctctagttagatatctgacttgggagtattaaaaattgggtctatgacatattgtccaaaaggaatgctgttcttaaagcattatttacagtaggaactggggagtaaatctgttccctacagtttgctgctgagctggaagctgtgggggaaggagttgacaggtgggcccagtgaacttttccagtaaatgaagcaagcactgaataaaaacctcctgaactgggaacaaagatctacaggcaagcaagatgcccacacaacaggcttattttctgtgaaggaaccaactgatctcccccacccttggattagagttcctgctctaccttacccacagataacacatgttgtttctacttgtaaatgtaaagtctttaaaataaactattacagatacttacgttgtggtgtttctttcctcatggaccatgatgaaaatcagtcttaaacaaggaccccttaaaaatcaagtacagtatctgttcttaaacttgggtacacaatagaattatctaggaagtttaaaaagacactaatgcccagcactttgggaggccgaggcggacggatcatgaggtcaggagaccgagaacatcctggctactatggtgaaaccccatctctactaaaaatacaaaaaactagctgggcgtggtggcgggcacctgtagtcccagctactcagaagattgaggcaggagaatggcatgaacccgagaggcggagcttgcagcgagccgagatcgcaccactgcattccagcctgggtgaaagtgtgagactctgtctcaaaaaaaaaaaacaaaaacaaaacaaaaaaaccactaatgcctggttgccactccagggattctggcttaaatggccggatacagcctgggcactgagattgttaagaagacccacagatgattctagtctgcgaacaggttagtgaagaaaagtaagttctgaagaccaaaccttcttatcccatagctgtaaagaataaaacaaataccagctgagccaaaactccaactgagcacaagtcatatccattcttttaccatctttgttgtactctaattataatcttgaatattaatagtattcttttctggcctccaactggagttaaagagaatgttcttggatggtctttctagattttgagcccagaaaagccaaagaaatatctattcttaaggatctgaaacaaaagggtaggcaggaattaacttttaaagtctagctcccattatcactttaactttctcgccttcacttcctttcctattctcccctcacgcattacagctgaacctcactagttaccttcctgtttctcaaacgtgtcagacacaggtccagcctgtttttgttcttgctgctgtctctaaaatgcaaatatcccaaagcacatgacttgtcccctcatctgcttcaaatgccaactcaagactgtcctaccttcttgcttcacaataacatgactccatcttacatatattttacctgtctgttcactgctgaattcccaagtgctcttcccttatcctcaactattacaggcctggcccccaaagcttcacattccctgccttggaaaggtttctgaagtccagagaaataggctttctctttccttctgtgattccactgttatgtttagacaagcccaatttaagcatccaagcccaccagcttggatcctaccactcacacaagcttcagctttttactcaagggtacatgagtagtttgatatcactatgtttaaagtctagaacactactgccacgggatccttggggtgttgcttccccagctggaatcctctgtggctggcagcccaaagtccagagggggcctaggcggcagggcgctggtgtcagcaccactcagagctcacgtacacctggccaggtcctcacagcacccgggcttggcctcacctttgctccagagcgagtgccaggagcaggaagaggccaagcagttgttggggggggggtgtggggggggtatttcccctcggccccctagagcacaaggatgcccgggtccgcagccacggctggacagctgtagctacgcttggctcctgcctatcacggctccccctcaacacccctcaggccaccactgccatccgctgccatcactatgaccgcaatatcccattaatagggttaatatcttgaagcaagtgtgtcatgtcttaagccacgttttaagatgccagttgtccacagggcagcagagcagtttttccataaggaactaagatgaacctttttagtcagcaaaaagaaaaatgctttaagtaaaaactgattatacccaacatccattgatctttatttgatttgacaaaatctgcatttttaaaagacaggtaacaaaatctgaggttatactgaatctgacaaattgagttctatagtatctagaatatcatataagaaatatcaactgagggaaaagagaagtaccacatgcagatgctcctggcaaggggggaactgtatctgcaggtgaggtccagagtgtgcagtgcataagaaaatcctacagaaaatgccgttaacttacttggatgaaatgtttttcctttgagggggaggaagaggtggtaaagaggggcaggaattcaaaggcatatgcagaatggcttctccatttcaaaatggtaataaaaatatttaaatcatggcactagggcacctttgaggaaaagaacatcttaaccagagtaggctcattgcataattctttagtaatatgtacaattttcaagtaattaagcagacttaaaggataattttgttttaacagcagctatctatttttcttctccccctctggggcttgatctgtttcagcatcacagggacacttttccacacattttctagggaaccaaccccttattcttgaaacacctgagggagaaaatgaaattgaggtgaaatagtctgatggatgacagtgacattactgaaagcagtaagtcctattacttcaaattaataagcttgtagttagacttttattccccactttgctatctattataagcacagtttgaaggggaaaaaaataagatttttaaatgttcataacaagctaggaacaggtatttcccaaatttgatgatcccgaatagggactaatgtggttaaagacagctcctaactagagtcagggggaactcggtatgggtgtttacttatatgtgtatgatcaggaaaggtgtttttggcacaccatcacactgtcttttccagggaactatcttcttgtagtctttgtaaatttcctttttagactttttctaacatatatatttctttcttttttttttttgagatggagtcttgctctgtcacctaggctgtagtgcagtggcacgatctcagattactgcaacctctgcctcccgggttcaagcaattctcctgcctcagcctctggagcagctgggattacaggcacacaccaccatgcccggctaatttttgtatttttagtagagatagggtttcaccatgttggccaggctgatcttgaactcctgacctcaggtgatccatctgccttggtctcccaaagtcctgggattacaggcatgagtcaccacacctggcctaacatatacatttctatatcacggccgtcataagaggttaatttatgattaaccccaactattttttaaagaacatcccgagctaatctttactttaaaaagaaacaattataaaacttaagaaaaaaaaaaacacaaagtttcaatctactggtttttataacaacttaagagaaatgctcaaagtgggggcagcaaatagtacaggggtttggtgcatagaatctggagtcagactgcttggggttaagccctagctccatctgttttcagtgcatagctatgggcaagttgcctctctgtgcttcagttccctcaatcaaatataaataatagtgcctacctccgaagtattttggggacttctacaccttaagggtagcacttatacaagtacttttcgcatagttatgagctcaaatgttagctatcattaaaaagacctgaaaaatacaagagctatagagaaatatataaggaagttccttttgttgcttagtgatatacccttctatgcagttcccctaatgcattaggcatgattggtttataaaagttattcttgtaaaatttggaattattgctaatagtcttgtcctttaaacatgcccttccatttccataccttctataaaggaatcatcaagaattttgtctccatataaccagtatctgaaatatttaaaagatgaaaattaattttttaggctagatattaattttgtccttgaagaagaaatgcagtacttcctattacttaccgtaaacctcttgtggctaaaatgaattcccctttttgcagctgtattcgaggctcttcggtgcagggacttgtgaagaaggttttgattcctttattcagagggcagcaggcaccactataatcttctattactttatagcgaacctgtcgtcagtgatcagaagaaacctttaaatattcacccatgatatctgagttttaagtctgaatttcaaattttaaagcaagatccaaaatatccagtgacaagccttctagttccccttctaggggaacctcccagttccccatccacctagttccctgggaggcaactaatgtttctagttctcaaggcttttcttactcctcttttcaagcccatagctaagaattagagttagagcagggctaagaacattctgccatgatggaaatgttctgtatgtgtagtatccaatgcagcagcacttgacacatgtagctactgagtgagcacttacaatgtagtgaatgcaaacaagaaactgaatttttaaattgatttaattttaacaaatttaaataaaacagccacatgtggctggtggccatcatatccaacaacatagttgtaaggataggtttcacattaaggagctgtattgaggataattattttcctatgttggcaatataaatggactaaattcctcccaacctctagtcccaattatttaaataaaaacaaaagttaactgcatcaaatttcaacaaatgtattaaggaatactatttaataaaggccaacaattggtttctagtcagtcaattaaaaaaactgtatggaagtacagagcctaacaaaagaaaaaaaaattaccactgcaaaagaagtacttacacttctgactctcttatctgctttttgtttcaactgttctatctgtttggaagaaataaaaagaaaaaaatgaagtctcttgtctcaatgttgaaaaatcgcctttcctcatcaactgtcagagtgatatggcaaaaccccaattttccagcatttcaagttgctgataatttaaaggccacaggttgttttagcatggaaaaaaaggccctatgctaagaaccagaggctgagagtgaggttttcttctcgctattcactctctaatgtcctcatctgtgtatattcctagagtgcttactgtggcccagggatcagggagtatattctccgccctcatgaagcttctcaggtgaaaacactgagattcactgattctgtagagacatggcagacaaactacaaatgaataatgaagaacatttaataatgaagttgaatgaataaaagtcatcataacttaatttgacatagctactattaaatagcactatattagatataataggagaaataaagataactcatgatctctgtcctagaatcttatgaagttacagatataagatagcagaattaaataaaaatatgagacttcatgagctaccatagagtagtatgtgattaaatgtcacattcagatgagtctatgggggtaggttagactttatggaagaggtaagactggaacgagtcttaataattttagatagagtggaggtcatataagatggaaaaaattgtgggcaaagttgggtgacaggaatgtataaggaattcatatgctactgtaagttggaaggtaatttttggccagatttcataaaactatgttaagggatcaggactttatctcacaggtatagagaattaaggagatattgaaataaagggagatacatgatacaaggagtgctttagaattattagattcattttgacatagtgaaaacattcatattacttattttactacaaaatgtcacttgagttgagggggagttaagggaaagaaggcgaggcaaaaaggaagggctatttgaacaaaaatactcactgttaagctgtattggtgacagccttctcttactggccactcaagtccatctccttcagggacccctgaccacgtaaatacctgtttaaagttcctccatctacttcccatatcatatggaaaaacaaagacttcatctagttgataatactgaattcgatctttagcctgtgggtaacaaagatataagatggcaggtgcctctgtctaagtggcctgcagtaatatgttattgagaacacttatttctcaagtttctaacattcataaaaatacttcctccttgctgtaatattagtgtacatggaagcaatagacaacttcatcacaatataggaagaacttgatatagaacaccagccttgtatgtgattacctaggaaatatctgacagggtttctttaggaataagcactcataaaggcttattaaaagttagctaactttatctcatacataaaaagtcctcaatgctcctagttgttcagcaatacaaaacaattcaggtatatagaagggatgcagataaacagattcaggagaaaggtaaaggtttattcaggatggaaccgttttattcaagatagaactgttttgtggggtgcaccagaatgtaacagttgtatcagagggtaacagttatatcctgggtggcagtgatgcccatgggaatgaccaggaaaggtgtaacaggagagctgttttatgaaaaacattttttaaagctagcagatatatacaggagatcttctttctttttttatactatcacacatgtacacataactcatttatatatgcatttatatgtacatgttatgcatgtacataactattcagcttgcatatattccaggcatttaaactgttagctttaacttgaggaaataaattggctttggatttcttaagttccactgacacctagtggtacaaagatacattatttattttaacaataagtatacaaatcccttcaaatttgttgtatatagtgtctggtaatttctatacatttcctataaatttaatatggtcatttgtttgaattttttactcagcaataaagtgcccgttctgaaataatttctagtctatggccataccattcagcatactcaatctcatctgaggtaatttctaaatgtagcatggcggtttataagcagccttggtcatccacaaaaacaaacaaaaaaatgttaatctaatgtcaatatatttattatgcttattagaaatgatactttgaaatatttgattatcaggggacaatgttttatggaaaatgttgcaattatttgttgagtgatattaaagttaactatttactaaaataattattaagctataatgcatatgaatctattaagttatataaatccatcctccccagaaagtaaagaataatttcattttcttttttataaacacagcttcagagtcttcaaaatggactgaatttcaaagaaaagagttctaggctatttacaaagaaaaactggtaaatataagagaatttataaaatgactaagacatgtctttgcctaacagaaacactcaatgaagttaggattctatcaatattgtgtgttaaaaggtgatgaaggggtgtggtagatgctatgggaaaagggaacaaaggaaacaaaaagtacttagccaagtctagggagtatccaggaagggtccttgggagaaacaataccttaactaagtcttgagaagcaagaaatcaggcaaaaagagagggaagagcattctaggcagagggaacaacatgtgcaaggatacagaagcataagatgtacaaactatgagtaatttagtatcaagtgtgagacagggtagagaagggtaggaaattaggctggagaagtagataaaaagaagtccgccaggtgcagtggctcacgcctgtaatcccagcactttgggaggccaaggcgggtggattacttgaggtgaggagtttgagaccagcctggccaacatggtgaaagcctgtctctactaaaaatacaaaacttagctgggcatggtggcatacaccttgtaatcccagctacttgggaggctaaggcaggagaatcacttgaacccaggaagtggaggttgcagcgagccaagattgtgccactgcactccagcctgggcaacagagcgagactccgtcgccagaaaacaaaaaaagaagtcataaaaggtcttacttatgtagaagctaagaagctcagacttcaacctgtacatcagtggttctcaaagcatgctttatagatcactttgagtattcaggactttttcttgctggtcagcaaggccaagctattttcataataatactgaaatgttatttgtctttttgttgcattgacatttgcaatggtgaataaaactgttggcatcttagcaaaaaccaaggcagtggcaccaaactgtgttggtagtcattatgagcaattccatgtaagaatgtccttgatgaagcagtaaaaattgtttttaaatattaaatctcaactctcaaggagatgtcctttatttttaacagtctgtgtgacaaaatgagaagtatacataaagcgtgcccaagtagaatgatcatctcaaggaaaatagttgttaagctgtaagctaacaaaagctgtagagccagcttttttaatgtaacactattcttatttgaaagaatgagtaatatagcaaactaaggttattcagacttcaggacttggtgaacattttctcaaaaacgaacagtcaggcagtcacttcaagggaaatgactgacagtatgggttaatagtaaaaaattaaggctttcaaatgtatactagaattacaaaaaaaaaaaccttgtatctaccactgtgagcctgacagctttccaatacttaaggattttttctcataaaaatgatatattgatatacgtgaatgcaattttgggatattgtataatgaaaggtgtttaacgtttgcaaaatctacataacacagtaaactagtatttgccaaatgaccgatgcctgatgttacataaaaccacatactggtaaaagattaattcaaagagcaagatagactgatgagttttaaaataaaaaggtataaaaatcttattgataagaaatatcacttgtcaagttttcaatgtaatacggaagaacatccactattatcatgtaaaaggcctattaaaatattctatccttttctacctacttatctgtgtgaggctagatcttcacatacttcaatcgaagcaacatatctcaacagactgaatgcagaagtgagaatccaaccatcttctcttaagtcaaagatactaaagagatttgtaaagatataaaacgatgctattcttctccctattttgtaatttggaaattgtgaatattcccctgtggcaacaatcagcttggtctgccaggcaattctttggtatacaggcttgctccccttcatggacgttatctgcccagaccctgcaggtatttgggtttcaacccctgccacaggaatggtgaggctctgagaagttttaaacacagagcagggtagtcagatttgtgtttcatgctagaatcacaatggacagtatgaagtattggacattgtgaggtctgtgacaagcaaaatgttaggagcttcattgaatgtctaaaacactgagaaaaacctgatggcagtttggtagggtggaagctcctttccaaatgggctgctttctcctctagtctaagagacaacaaacagatggtttgacgtgtggcttaggcctctgcgaccactcagggtgtatgagaagcacctttctgtgggagttacagaatgaacaaaaatgtttcctatattcaccttttatgtggcatgcaaatgacttacggtagccatttggcagccatgttttcacttttaggcacttttcgttaatccggtctaataacagactttattaatattcaggactttaccagtcctttattaatatacttttttaatattgaagaaacaattattaaaatttaccttctcttcaatccatgactcaatagaagttttgtttctgagaat

SEQ ID NO: 488 - DNA, 72922 bp, Homo sapiens
tctcgaactcctgaccccaggtgatctacctgcctcagcctcccaaagtgctgggattacaggtgtgagccaccgcacccagcccactactagagagttttaagcaagaatgtgaaaccatctgttctgtgtgttattgttgttgtttgagacagggtctggctctgtcaccccagctggagtgcagtggcaccatctcagctcactgaaacctctgcctccctgcaacctctgcctcccaggctcaagccatcctcccacctcagctcagcttcctgagtagttgagactacaggcatgccccactacacctggctaatttttgtattttttgtagagatgggatttcgccatgttgcccaggctggtctcaaactcctgacctcaagtgatccactcacctcagcctcccaaagcgctgggattacaggcatgagccactgcgcccggcctgttttgtgttttaaaatgatccctctggctactgtctggagacaaactggaggacgataagagtggaggtaggagagaactgaaagctcactatttgctggtggctatggacaagtcagtcaagtcatgcacctcaccttcctcattctagtaatggaactaatccctaactggtgggataggggtacaaggattccatgaggtgatgtgcacccagtgcactgtaggtactcactccaagttatttctattccttttccaccttgaccagggctgagaccctcttccatcccatagctccctcctctgagtgttattagctgtgaacccaggtccctaaatggcctaaaggtcctaggtgtttgtgaacagtaaagaaatagtctttactttaccttgacctcatgctgtactcacaatatgttttttaaagtttattcattcaatttttttagtacctgctactatgcactaggactataacccctttaaaagtctatgtgataatattaaaaactgaccattttattgttctgtttaaaatacgtggttcactgatgccaacataataaacatctaagctccttgtggtgtttaaagaccttcatgatccacagtcccatcttttgtgtaaataagaaaccaaatatatagataaaatgatgatatatgcaagaaatgtttataaattattacagaagttactcttgggaaaggatactgaagatgggaatgagatggggtgggagtttttttggtttgaaatttttaccacttatatctatttcctttttagaaatcaatacataaaccgggagtgctcgtgcatgcctgtaagcccagctattcagaaggctgaggcaggagatcacttgagtctagaagttcaaagctgcagtatgattgcaatatgaatagccactgcactccaggctgggcaacatagatagaccctgtctctaaaaaaaattaacacatatattttgaaatgaaaaggaaaaattacagggagataggaatgggaaaggggacttttttattcttcctcactattgctttttttttttttatcatgaacatgtaatttttgtttttgtttttgtttttgagacagagtctcactctgtcgcccaggctggagtgcagtggcgcaatctcggctcactgcaacctccatctcccaggttcaagtgattctcctgcctcagtctcctgagtagctgggattacaggcacatgccaccacgcctagctaattttttatatttttagtagaggcagggtctcaccatgttggccagtctggtcttgaactcctgacctcaggtgatctgcctgcctcagcctcccaaagtgttgggattacaggcataagccaccgcaccctgctgtttttaaactttattttcaaaaaaaggttatcttctgagactctccctcacttcataatgcttgcctctaaccctcaacatcagcatcacagagtctgtaaataaaactggaattcatccaaacaaacagacgttaaacacccactgtaggcacagaactctccttggcccctagaaatgtcttgttgttgttgttgttgttgttgctgttgctgttgttgttaatagagacaaggtcttgctatgttccccaggctgttctcaaactcctgagctcaaacaatcatcccgcctcagcctcccaaagtgttgggattacaggcgtgagccacagcacccggcattagaagtttcaaaagaagtgtgggaaagggttttgaacttatatttattgatgctgactacatattaagcattttacatatattcctttattgaagtgttcccaagactttatgaaataagtcccactctcgccactttacagatgagaaaactaagaccaagaaaggtgatattgcccatctcaggtcataaaatgagtaagtgggccaggtttggtggctcacgtctgtaatctcagcactttgggaggccgaggtgggaggattgtttgagcccaggtattcaagaccagcctgggcaacatagcaagactcctgtctctacaaaaaaatttttttaattagccaggaatggtggtgtgcacctgttgtcccaactactcgaaaggctgaggtaagagcatcacttcagcctggtagttcgaggctgcagtgagccactgcccaccagcctgggcgacagggtgaaaccctatctcaaaaaatttaaagtaaaatataaaataaaataaaatgaataagtggcaggaccaagagtctgtgtaactagaaagcctccttcccattgctccacatggcatcaagagccatttctaccctcagaaaccaaccttacaagctaatttttgttgctatttcttggtacttattgctttgtttttgagagataatcttcctgccaggctggaatgcagtggcgcaatctcggctcactgcaacctccgcctttgggttcaagcatttctcatgcctcagcctcccaagaagctggaattataggcatgcaccaccatgcccagctaatttttgtatttttagtagagatggggcttcaccatgttggccatgaggctggtctcaaactcctggcctcaagcaatccgcccgccttggcctcccaaagtgttggcattacaggcgtgagccactgtgcccggccctaggtatggtttaatttgttttctccagtcagatataaggatccaggaggtaaaggtgacatgtccctatcatagctattcaagactctctactccaccagtccatcataaagttattgatttatacaataaaaatatttactgagtacctactatgtgcactgtggaacagctagggcaataacagtgttgattttactgatagggaagagcaacagcaggatactggaaaaagattaatttgcaaccagaaggaataagtcttttgggagaaagatgacaagttcaattttggttattataaatttgtgggacaccataagaagctgtctggaggcagttggcctagtagatatctaatttttaccttcagggctcatccctggtatctgcttggataccacttctcattcaattttcttttaaggaacattctctctcctctctcagccaactccctcatccctgaccaaagtatataactcagacttggccagtcagaacaggtacctctgtgcagtaacaggcaatgtgaacaaagccaggccaataagacccaaactttgttattttgctggaactactgggaaagagaaaggctcctctttctattacacttaagttgctaagttggtaggatgtaagcctgtagctgctgggggcatcttgcccctaataaaatgggaggccttctgccaatgaagcccaccaaaagaaggcagagcaaaagatggagaaaagtccattcctttttaggtaccttaatccagctatgcctgaaaccccatatccctggacttttcagttatgctacccagtaaaattctctttttggatgtagctcagttaaactgggtttataacaaaataatcctgaacaaaattgattatacaagtccagagtttaggagagtgatcttggctagaggctagggtcatccctggcttgttgtttattcccttaaggggagaatcactaaaataaataaataaataaatatatatatatataaaattttgaaacagtgtctcactctgttgcccaggctggagtacagtggtataatctcagctcactgcagcctcaaccttcagggctcaagccatctgcccacctcagcctcccgagtagctgggactacagacaggcatgcaccaccacacctggctaatttttgtattttttctagagacagggtttcaccatgttgccccggctggttctgaattcctgagctcaagcaatctgcccaccttagcctcccaaaatgctgggattacaggtgtatgccactatgcccggcagaatcaccaaagatgtctgaaccagggagtgacatgaccagaagcgatggatggattggggtggggactgggcaagagggaggaggcaggaggagtagctagaagcctataaataatattgataagagaggttggtggcttagtctacagtggtgatgacagggatgatgagtaggaatttggaagatacttaggaggggtgcagagagcacttgatcaccatttggaaatgagaagaaaaggaggagtccagcatgccattcattattgggagactgggtgactggcagtgtcattaatggagaatggcagtggaggaagagcaggtgcatggggaagggatatgatgagttcaaaatagaacatgctatagatgaggcacttgcaggacatctggagacacaggcctgggagagaaaggaacacaagggcttggagctcagaagaaagaaagtatttcccaaccttggaatgatcactgtctagctctctttcccacagagcctgatgtggggtgcctggcacttgggtttagggaatggcaggctagaggctagctgggcacaaccaaggtcctggctaagaggatggtgctgtgccactagatggtaccaccaggttgagaacacaggaggccatgtcagcctgtagtctggtccaggtgaaccgaggaagccttggggcttggaagtaggattgggagatatggcattcaaatgattacactgaaatgatggcaacacacaaacctgacacataaatttggcataaggtataaactcccagaagctcagatgactaggatctctgctggatttccatacaggggtgagggcagagcctgtattgaacttcccaaaatactccctgaggttttggaacttgctctctcctaccattctttcatcctctctcctaccattctttcatcctgagatcttctctctcatgcatttattcattcaacaattattgagtgcccaataaataaatagagatgagggttttttttgttgttgttgtttgtttgtttttttgagacagagtctcactctgttgcccaggctggagtgcaatggcgcgatcttcgctcactgcaacctctgcctcagcctcctgagtagctggggttacagacacctgccaccaggcctggctaattttttttttttgtatttttagtagagatggggttttgtcatgttggccaggctgtttttgaactcctgacctcaggtgatccacccgcctcagcatcccaaagtgctgggattacaggtgtgagccaccacaccggccagtgtattttgttttgttttttgttttttgtttctttttgagactgagtctcactctgtcacccaggctggagtgcagtggagtgatctcggctcactgtaacctctgcctccccagttcgagtgattctcctgcctcagcctcccgagtagctaggattacaggcacccaccaccatgcccagctaatttttgtatttttagtagagatggggtttcaccatgttggccaggcaggtcttgaactcctgacctcaagtgatccacccacctcaggcatgagccaccgcgcccggcctatggataaggtcttgatgctggagaaaggagagtgaacaaaacaatcatgatccctgccctcatggggcttacagacagggagtaatcagataattgcacaaataaataatcatagattttggtaaatgctaagacatttacagagggccagaagaaaacatgtcaggcagttccaatctctaggtcaagagagacaggcattctctgttgagctggaagaggaaactaaggcccaggacagggtaggtgtgcctgttgtcgcttggtgagtcagggctgtattaggaccagaagtctcactcctgactactgaataaaaggcctagcttcaggctgatatccatcatgacacatcttcccactcctctccctgctacctcctgattccactccctttggaaaataagttttgatccgcagccctgacatttgacgcccataaacctctaaactccatcttcattatctcctcacccccaccccatacagagtgcagtccagtcaggttggcaagggctgctggtcagggccagatgaccagaaagtgtagaggaggagagaatttggggctttcaggctgggagcagctagggaagggccaagccggaaaagcagcatctgccaggctggtaagagacaaggctcaagtgcaggcactgcgaggaagcgagagtgaggtagaaggatgctctaatgccaggaagtgacgtgcagggacagagggatgggggatgaaggatgaagaatggaggggaggatgaagctgggccacatggctaggaggaagagcagcagggaaggaatgcacagagagctctttgcccccaggtctcttccaatccctgtctcctccttctcttacccccacttctcacaattccagcagagggctgaggggaacacagtaaaattctggagactgcttcctagggagcagagtaccttactaataccccggccagatccatggctcagggaggggtggggtaatccacaggagagtgaaggcgttctagtccccaaggacttttgagaggtcatgcagtccatgcctccgtctcccaacacccaacagaggggaatcatattctctttacccctccctagacatgaagagattctccgcttctcccagaccctctgcttctcacaatccctggctgtggggaacttctcttaaggcacagattggatccctcttgctgcagtctctgacttggtttctcctatcctgtcctctgtggctagagaaagccctcttctgggtgatcacagcggttccttaggatctccccttcaacattccttcatcgttagttggttcttcccagaaggtaagcccaatcccttctactgcagtccctagcatcctctccgttgtcgcatcctacgcctccaaggcagaaatgcacccccttcctcaccaaataattaacagagacaagggagaagaagggagagatccaagaagatggggatgaattaaggagatggagctggaggtggatgcttgacacagaagaaggaagaccggggacttcccaaggcagggcagggacggggtcagcgggcctcaccggtgtcggggtctcccagaaaggcgtcctcgtccttgcggcccctcagcggggccgcgggcgccggctcgtcctcgggcagccgcgggaagctggtgatgctcatgtagtccactggcgagtaggcgcccagggcgctctcctggctggcctcgttctccgccgccatcctcgcccgcgccccccagcagcgcagcgcctgccggaagtggctgcggcgggggagtgggagggcggagggcggggcctgatcttcgcgacagccgggagggggcgcctctcccagccctcggccgtgtcccggtctgactcgcccccgtctgctcagcgctatcagcctgcagctggcacacaggtgcgtgtagatggacagccaggaaggcagcgcagggtcgaggggagagcgcggggcaagcgagacttcagtggctctgcactttacgcagctcagggaccaaaccccttcctccttccagcctgaatacagctagtgtcctcctcaaatcccaggcttccttttcgggccccagaccctttcactgaccgcaaatccctctcgaccccagatcctgtctctgaccccaaactcctcggaccccagacccctccttgaattccgagatcctcctcctccgattttagactcctcctccgaccttagacctctttttcgacttcagactctgtcttcacccccaaacccttttgaaaaccccagcccatgcttcatctccaggcctctttgactgcagacgcctctttggacaacagatccctcctctgacctcagatcccttcccgcaccccgacacttctgactcctctttcaaccgcattctcaaactttagtgtgtgttaggatctttgaaagcggatccccagattccactccagagatcatgattcagtaggctgggatgaggtccttggaacctgaatatttaccatcattttaagagtttttgatgtggttctggaaaggacactttgagaaagaaggagtggtggtagtgatggtagggcaggagtggggcaaggtggggaataggtctccatattctggatgtctgggttctattctgccaccgctcaaacactgtgtaatcttgggcaagacaattagtctctctatcagtttccccatctgtgaaatggaaagaataatagtacccattttagagggttgtcatgaggattaagtaacagaatggaaagcgattagtatagggcttggcacctactcaataaatggcatcatcatcatcatcatcattgccttaatctggtagattcattccctccaaactcatccatcctctctccactccaaaattccaaccacactacagcttgtactacttctccatatccaaggatgagggaggttccttcttttacgaggtctctgttccaaactttcattgtgaagtccacaggaagagaggggggctggtgaagcctctatacacacatcctttctcttcccaaccccagaccagtctcagggatggcctgaagtgcttgaaaaatctactatatacacagcagctgcagtagcaactatagacaggagggggaagcagtgtgtcgggaacagctctggggtttgggtgtaggacttgggagagaggataggaaggagagggctactcagagctgtgtggtaagagtgcccagggagggtaacagtctatcaccaaaaagtgtacccattgtctgtgcctttccccaccccagagagttcttatctcctcagtgatgtttgtagggtctattacactaccctgaggtctaatccctctggtgggacccttccccacttgatgaggtctgcaccttctcagtgatgtccactcccacagtgtagttggcagctcctcactggagtttgagtcctctggtagggtccacgtctccttagtaaagtctatatcctctgtatctcttaggggaaatccatgtctcctcactagggtaagtgcccttcaaagccattcatgtcctattagcagggcccagggcccttcagtcagatctgagaacccccagcaacatctgtgctcccttagtggagtccatgtactgtcagtgaagtgtgtgtcccttcggtgcagtgaatatctcctttatgaaagtatctgaccccttggtggggtctatgtccaccccaagaggtctgtactccttcagtgggccctcagattcccgccctccttgggattgggcagactctcggtctcccatagagagattttttttcagcttagggtgtgcaaggtttacagtcagctgggcaaagtgcagggaagtagctgggaagggaggctgggctagatggggtcacaaggcctgtgtaggcttcaggaggtgggagctgcccgcttcaggcctcagaatcactcttggagttagatatttaagaatccttcctgccttgacagccagtctgtgaaatgatggtgaggtgggcacttctttgtggtgagtgcaggtgagagatggaggagggtcctgcctgacttctttctggggtggaggggctagagagaagctagaggtaattaagcccaggttgtggtggtggtggtgggggtttcccttggtggagtaaagagattgtgaaggaaagaagagaatgtgggccaggtgtggtggctcacgcctgtaatcctagcactttgggagcccaaggcgggcagatcacctgaggtcaggagttcaagaccagcctggacaacatggtgaaatcccatctctactaaaaatacaaaaattagctgggtgtggtggtgtgcacctgtaattccagctactcgggaggctgaggcaggagaattgcttgaatccaggaggcagaggttgcagtcagccgagattgtgccattgcactccagcctgggcgacagagcgagagactccatctcaaaacaaaaacaacaacaaaaaaagagaatgtgaatgatttttcctatttgcacagactttgatattttacaagccttagcttcaagcctgacgaggaagtaaaaccaaatctggagtcaaagaacctagctttggccctaacttggtcgttatttgctctctgactgtgcaccagttccttccctttcctgggtttgccatttgtgcaattaggaggtgggcttattacaaaaaacctgaaggtgtctcctagtcttcacttattgagtcttgtactttagatctggatggagatttgtgaaggcaaggagattgaagacatgtcctcataagagggagaaaatctgagctggttccagggtgagcagagaggaggtgctgtcgccagagcatgccctcaaggtcatgggagaagtttttccggaggacgagaatgtgggtgtggctcagagaggggggacctggagggaagggtgtcacctggaaggaactggtgatagtcaggactgtgcaatcagatcacggggcggctccgcgatggaccttactcaactcctctccttagtccatccctttccctttcgatccttgccttaacccaaccccttatctgtcactccaagaccccaccccactctggtcactccatggctctgcctcctctcctgtcacaaccagccgggttactccccatcactccatgggcccacctcctctcctgtcccgcctggccccgcccctcccttggcactccacggttccaccctctcccttgtcacacccggccccgccccttctgctttcactcgacggcgtcactccttccggcaagtcagctccacccctatccctcgacttttccttatagtatttctgtccttgccaacctcgatccctccccaaccagacacggccccgccccctctggcaccgcccacccgccagactaagccactcccccactcaccaggccccgcccctctacggaggccccgcctctagttcggcctgttttctcagtcccggcacccgccgcgaccgcaaaggcggccgcggttctaggaacttgacgtgatggggcttcctgaggagcgggtccggagcggcagcgggagccggggccaggaggaagctggagccggaggccgggcgcggagttggtctccgccgcccgaggtcagccgctccgcgcacgtcccctcgctgcagcgctaccgcgagctgcaccggcgctccgtggaggagccgcggggtgaggcccggcccgggcgggcctggggtgtcagtgaggagaagagtgggggctccctgggggagtcgggggctcccttgggaagctgaggggtgggtgaggagatggaggttctgtgaaggaagaattgcggttctttgaaaatggaaaagggattccgggaggagacgagggttccatgggagctggggagttccctgcagacttggagggtccgtggtggagatgcgggtttttgcgaggagacgcgggattccgtgagggaagaagtgaggttccttgagattgggacggggaggtcggccaagagagtgaaagtttcatgggaagagaaggggagttcctgaggcgaaaagagggtctctaaggggcgacgggagccttgaagggaggagggccacgaatagaactttctttgcttccctttcacaccagctcagccactgcctcctgagacccttaacctgtgaactgttgagggcaataacgggtctggttcccatcttggggtcctcagattagtaatggagtccccgatctatttttagtatatcggacatcctaatggaaattacgcggtataagactgaacgagttactacgatgtcaagttgttttatttatttttttaacttgggctgggattgtattagtaatagttcagaagttctgatagatggttccatgtctgttaaaatgtatgaggaaaatcggccaggagcagtggctcacgcctgtaatcccagcactttgggaggccgaggcgggcggatcacttgaggtcaggagttcgagaccagcctggccaacatggtgaaacccccgtctccactaaaaatacaaaaattagccgggtgtggtggcgggcacctgtaatcccagctactcgagaggctgagacaggagaattgcttgaacccaggaggcagaggttgcagtgagccacgatagcaccactgcactccagcctgggcgacagagcaagactttgtctcaaaaaaaaaaaaaaaaaaaaaaaaaaaaaaaggtataaggaaaatccccctacccttgccctcagtctgggtaaaggacagatagatagacagatagatagatagatagatagatagatagatagtttgttttgagacaaggtgttgctctgtcacccatgctggagtgcagtggcccgttctaggctcactatagcctgcatctcctgggctcatgcgatctttccgcttcagcctcctgggtagctgggactacaggcggacgccatgacacccagctacttttttgtattttttggagagacgaggttttgccatgttgcccaggctggtcttgaactcctggcctcaggctttcctccttacttggcctcccaaagtgctgtgattacatgtgcatgagctactgcgcctagccaaggagtcaaaattgcacccccattgggaggcagcatgatgtttggttgtgggacaaacatgggccacgaatcaaatccagaaaaatctagatttagaccctggctctgctgttcatttactgtggggtcttaggcaaatttttaagcctgtctgagattccttttcttccatctataagataggtctagtaatacttgcctaatgggtttgtatgaggtctaaagtgtgtaataagtatgcgctataacatgcctgatgcacagtacacattcaataaatagtagttagtctgatacaatataaatcaagcaattaccaagtaatgcaagacaggattcaatcaagtgtaaagtggtggagttgggatttgaaccaagacagtttgactgcagaatccatatcctaatagcaatgctattcctcttccatgaccccacagaatgcatttcaccaaattccatcaaatacagaatttctaccagggaagcagcctcctaatttgtcctctcttgcctagtttcgccaacttgagtctttccagtagatttatcaagacaccattagattgatattatggaaatatgctttcatatgtcactgcaaaaactttcaatggttccctgtttctggcagtttctaattaaaattctgcttttcttttttttttttttttcttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacgggctttcaccgtgttagccaggatggtctcgatctcctgacctcgtgatccgcccgcctcggcctcccaaagtgctgggattacaggcgtgagccaccgcgcccggcctctgcttttcttttaagacctccagataatctagctccaccctgcctctctattcttatctcccactacttgctaccactcccctcattctagatagatcattctccttgatatcctggatacacatttattcccaccttcttgcctttgttcatttccttctgcttctctctacctagtcaaactccaccacttccaatagagcattcactgatcatcccaatttatgctcacctttttcctcttctgaatatctttagtacttagaaactatgccactcatccagattctgacacacacacacacacacacacacacacacacccctaccccccccaaaaaaacccagaaaaactaagtgtgcataaaattcagttttgtagccaaacatggtgacgcacgtctgtaatcctgctactcaggaggctaaggcacgagaattgcttgaacccgggagacggagattgcagtgagccaagattgtgccactgcactccagcctgggcgacacagcgataccctgtctcaaaacaaaaacaaaaacacctcagctttcttcattctttgttgatggacataaatgtggtttataaatagttttatatactatatgcctactattatcacttgaaaatatttttgagtatttgtactctcgttattagctgcgtggtccttggcagagtttcctgtgcttcctgagcttcagttttctcatctataaaattaggataattaatgtatactttgtaagaccataatgtcataaagattaaatgagattagtccagtccctgatacatgaatggcatttactaaatactagctctcatttgctttctctttaatggccatttattattctatggtattactacttgtattactagttttcatcagtttgttattgttgggctattgggttgtttccagtttcactattatagtgttgctataaacatctctttactaatcactttttttctttgtgattattttcttgaagtctattccctatagttgagatagcagagaaaagggtataaaaagttttatgggctgggcgtggtggcccacacctataatcccagcatcctttgggagggcaaggtgggctcccaaagcttgagcttaggagtttaagaacagcctgggtaatatggccaaaccctgtttctacaaaacaaacaaacaatgtgcgcctgtagttccagctactggtgggggagggggtacagctgagatggggggatcacttgagccagggagatggaggttacagtgagctgagatcatgctactgcactccagcctgggtgacaaagagcgagacaccgagctaaaaaaataataataatagaaattaaaaaaaaaaagttttatggctcttgtcatgcattgccttgcaatctaataagactgcgccaatttcttacaatgccattattgtgtaagagtatctgttttcccagggccacccagacattgggcttaataatttttttaaatttttactagttttctaggtatataatggcaccttggggttgatttaatttggatttctttaatacattacaacgttgtacactatgtgatttagctttcaattatattctgtcttgtacattaaaaaatatttcatgtgttaatcttatctctccaactagattgtataagctctaaattgtgtaacctgaaacaaatgacttagcttctatgaattttatttcttatgaaatgaaatgagggggtgataatctgtaaggttacttccattgttacggttctaattgcttctctttcctccaaatttttttttttttttttttttttttttgagatagagtcttgttctgttgcctaggctggagtacagtggtgcaatctcaactcactgcaacctccacctcccaggttcaggcgattctcctgcctcacgctcctgagtagctaggaatacaagcacccgctaccacacctggcaattttttttttttttttgtatttttagtagagacaggatttcaccatgttggtcaggctggtctcgaactcctgatttcaggtgatccgcccgccttggcctcccaaagtgctaggattacaggagtgagccacagtgcctggcatcctctaactcttgattcagtactcagactatcctaaattctctgcattcatatgttttacctgttgagtacattttctgcagaatagccaggcagatattttaagaatgtaaatttgatcatgttacttgcttaaaacccttcaatgaattttcattgctcttgggatatataccaaattccttattatacacagaattgcatgatttgcccagtttatgcatcaattcctgctattctttcccttattctcagtgtttcagcctcaaggagttcctcctaacatatgcccttggtctctttttttcatatgggagtggagaaaaacttctattcatctttcagattttagcaaaaatgtctcaaggaagtttagatcttgacttagtaattgtgtaaccttagacaagttatttaacctctctgagccttgattttcaagtttataaaatgagaaaagcctcccttctagagttgtggtaaggattaaatgagataatacatatgaaaagcttaaagaaacatttggcacatagtgaataacacttatataagtagaagctggagaaggagatgctcaatatataattgctgagagagaatgcacgaattaagagaagaaagagttggtcatggaaggttctgtgggtgaagaattttttctttttactaattacttcattaaaaaatttactttctagttagacagatggtgaaaaaaattgtacctgatttcagcagaactcggtgtgtacctataatcccagcttcttgggaggctgaggcaggaggacagctgagtccaggagtttaagacaagcctgggcaacagcaacaaaaaattactgattgcctattttgtgctaggcattgtgctagtactaggtggctctgattttaatagatggtaaaaagtgagtaggcagtcttgaggacaggaggaagaatttgagtcaagattcagcccaagagaatagaagatgggttagaagagtgttggctgctggccgggcgcggtggctcaagcctgtaatcccagcactttgggagtccgaggcgggcggatcacgaggtcaggagttcgagaccagcctggccaacatagtgaaaccccgtctctactaaaaatacaaaaattagccaggcgtggtggcacgcgcctgtagtcccagctactcgggaggctgaggcaggagaattgcttcaaccggggaggcagaggttgtggtgagccgagatcatgccactgcactccagcctaggtgtcacagtgagcctccatctccaaaaaaaaaaaagtggtgggtgctaagattagacaggtaaagaagggacccaggtggtgggtcctagggcaaggaagttataatttggtcctgtgtatagactggtaagccttctgaggctaaatatgtctcagaagattaatgatatctgggcttccatttctgttgcagaattctggggagacattgccaaggaattttactggaagactccatgccctggcccattccttcggtacaactttgatgtgactaaagggaaaatcttcattgagtggatgaaaggagcaactaccaacatctgctacaatgtactggatcgaaatgtccatgagaaaaagcttggagataaagttgctttttactggtaaaaatatctatcttatacttggtggcagataaaaacactcatttgatacttacaacaacccagtagagtaagcaaagtgtcatcaacttaatgcctcaggtgaggaaaaatacctcaaggaagctacatgacttccttcagatcacataactagtatgtgacagagctgacattcaaagccaagtgtcctgacttctagtctagtgttcttggctttgtagttgaagagggagaaagggcattggcaaatggaagagaacaagactgagtagctttcttcctcattcttgctttggaagacaaatagtattgggtttttcaccaccactactaccactaccattatcattatcttttacagagctgtgtgccagaaactatgcttaagtgcttaacaaatactatctcctttgatgcttataataattatgaaagcactatttgttttcctcattttacataggtgaaaactgaaattctgagaagtcaagtgacatatctgaagtgaaacaactagctagaagcaaggctgagattcaaacctaggcagtataattacagagcttacacacaaccatgacactctattattcctctaattccttaccttggcctctcaacaggtttgtaaaataggaattcttagtttcattttataggtgaacaaatgaagcattgaagggttatgtagtgaataaggtcatagagtgaataagtggtagagccaggattcaaattcaagtctgcctgactccttgcttgtaccactaggccatgcagcctccccagcaggaaatttctaagactgcttctcccaggaatttagctgtctaggagatactactataccgaatccaaataggacttagaaattccaataattggggtgttgcttctgccacaatctatgagcactcagagttgatctattgtttttgtattgttttgttttgttttgtttttttggagacaggatcttgctctgttgcccagcctggagagcagcggcatgatcttggcttactgcaacctctgccctgcctcccctgctcaagcaatcctgccacctcagcctcctgagtaggtgggactacagacatgcaccaccacgtttggctaatttttgtattttgtatttagtattttttgtaatgatggggtttcaccatgttgcccaggctgttctcaaactcctgaactcaagcgatccacctgtcttggcctcccaaagtgctgggattagtgtgagccaccatgtctggcctgattaattatttaagctagccaataggagcagcttggatgcttcatgggagagttaaattgaaactcactcaatatctttgcccagtttgtgtgatatattgagaagagccttaacctgagagacaagaaatttaggttctcctttcaactctgccattaacatgttatataaccacagacaaggcatttaactaagagtcagtttcctcttccataaaatggggataataattctatccttgtttttctctctagattgttgtaagaatcaaatgagataacgttgtaaaagcacttatttgtttattggaaaacactgtataggtgtgagtggtctattattatactaccattgcttagttgggggccagtttgtcactgaaattcactgtccattgtgtctgttgagactctctttagcttctgctctagagctttatgcttgagctccagccaacacttgggctcatttcccaggctctttaaagatcagaaaacctttaaagatcttcaaaggaggccgggcatggtggctcatgcctgtaatcccagcactttgggaggctgaggcaagagggttgcttgagcttaggagtttgagaccagcctgggcaacacagtgagacccccatctctatttcacaaaaaagaaagaaataggctgggcatggtgcctcatgcctgtaatcccagcactttgggagaccaaggcaggtggattgcttgagctcaagagttcgagaccagcctgggcaacatggcaaaactccctctctacataaaagacaaaaattagctgggcatggtggtgcacgcctgtagtcccacctacttgaaaggctgtggtgggaggattgcttgagcccaggaggcggaggttgcagtgagcacagatcacaccactgtactccagcctgggcaacagagcaagaccctgtctcaaaaagtaatagtaataaaaataaaataagaaaaataaaaagaggaaaaaaaagatcataaaaggaaatgcttgtatctgaatttgttccctggtttgaaagaactcaggtgcctaatggaaaacagaatacacaggccagagttttcaatcactggagagttttccagaatcctgaggccctttctttctagagacaccagttcccctaccacccttacctgaacaggctctggagagcctctctttccccatctgtaaaatgagaggagtagactagatcagcattttccaaagaatgcttcaggaactgctaattactggagatattagtagggggcttcttaattcataaaatgattgagtctgagaaacactacataataaattgcctttgtgtgagattcccaatgtgtattagcatagtaaaatctccaagatgtcctatattagagatacctgattaattttgtttaacataggatttcctgaatttattgaagccccaaacactttttgccagcatgctattgatatcacaagaagcagtattccatggaacacccactggggaagcactggattaaataatctctaaatttacttccagtgcaaaattctgtaactcaaaaacaagacatcctcactccatttttacattggtcactccctcaacaagaattgttaaagatattggatactcagggctgcattaggcattatggatatgggggtaaaaaggcaggagacaagtaccatataggcaattactatttaattattttatgtttatagtaaagcaaaagcaaaatacaaataaattgcattttattataagaaagtaaagtgcaaatatgccggatatgtggttacatccctttgttgcctctatatttttaaatgatatgcttatactgctatttttcatcatttttaaagaaagtattgatttcttactacgatagataagaatttagttcttatatacctctctaacttccttctctcttcttctcaatataattatagctgttttctagttaatttaaaatcagtttacataagaatagcatactgtggttatatttccttttatgtacggatttttatttactctgaagttaataattgcttactgggctgggtgcagtggcttatacctgtaatcccaacactttgggaagcagaggcgggcagatcacctgaggtcaggagttctagacaagcctggccaaaatagtgaaacctcatctctactaaaaatacaaaaaaaaaattagctgggcatggtagtgcacacctgcagtcccagctacttgggaggctgaggcagaagaatcgcgtgaacctgggaggcagaggttgcagtgagccaagatcacaccactgccctccagcctgggtgacagagcaagactctgtctcaaaaaacaataaaagtaataataataattgcttaccgtttttctttttgtactatttaagcctttatcatatatttaatattttccaatctcactatcatatgaaatcctccttttcctcccaaagttctccctcttggagctcacttctttctgttctaattcttactaatgcttttaaaaatgacatcttttctgtgattcgctccaattgatatacttcttatagaaacacattatggctttcttcttaactttatgtcatttagacagctatggtggcattaacaagccacatttgtagctagtttcttgttttggaacatacattgtgtagtcattgaaattatccacaaaggaaatggtgctcttaggaaagtactcccattatccaaaatagaaccatattaaggaataatttggccttttacttttggcttgacacattgcaaatgttcacggaatagtagtatttttagaacttgaagtgaccgttagagtccatctaggccaactctcttcaaagattggtagattaagggacaaagaagctaagtgatttgcctaagggtcatacacctgtttgaagacagaactgagactaatctccagatactctcactcctagtcaactattttttttcactcgtgacactacctcattattctagtagtccagcacttggctgtgacagataaaaagagaaattagccacattagccaaactgatttaaattaactttaaaataccagataaaatgtgttattaggtttaaatgtcccagaccctagtctcatggaatttacattctatttggaaagaccaaatagattggccgggcacaatggctcatgcctgtaatcccagcactttgggaagccaaggcaggtggatcacctgaggtcaggagttcgagaccagcctggccaacatggtgaaaccctgtctctactaaaaaatacaaaaatcagctggatgtggtggcaggtgcctgtaattgcagctacttgggaggctgaggcaggagaatggcttgaacccaggaggcagaggttgtagtgagccgagatcgtgccattgcactccaccctgggcgacaagagcgaaactccatctcaaaaacaaaataaaacaaaacaaatagatctacataaaaacagcctgggccaggcatagtggctcacgcctgtaatcccaacactttgggaggctgaggcgggcggatcaccttaggtcaggagttcaagatcagcctggccaacaagacgaaaccccatctctactaaaaatacaaaaatagccaggtgtggtggcgcactcctgtaatcccagctacttgggaggctgagacaggagaattgcttgaacccaggagacagaggttgcagtgagccgagatcaagccaatgtactccagcctgggcaacagagcaagactccatcaaaaaaaaaaaaaaaaaaaaaagcctgaaaagaattatgggccaaactgcaaagagctacttacacaaatagttcacagaaaggaaaaagccttatagggaggcaggataatataaagattaggagaatgggtgttttggtgtcagactaacccagtttgagtcctatttttgccactaattagctgtctgatcttgggcaagttacttaacctctttgagcctcagttttctcaactgttaaacgtggataaaaatagcttttatctcatggagttgtcagttttgtaagattgaataggataaaaaaaaacatgtcaaattcctggcacattgaatgcacttaaatattagccaccacaattatttatattggaacagtgagaagaccaagcatgtttagagtaaaaggtttatgcagggaacaatttattcattcaataaatgcttactaagaacttattaagtgccaggcactattctaaacaaagttcttgccctcatggaggttatagtccagcttgaggagacagacaataaacatagaaaccagtaagtatatgacaggtagtgatgagtactatagaaaaatatagagcagagtcaggggaaagggaagtgacagtgcagagtgggagctgataaggaaagaaccttttgataaatatgacatttgagcagagatctgaaggaaagtatggagtgtgccacgcagatagttggggtagggaggggaaatgttccaggtaggtggagaacaaatgtgctgctgcctggtgtgtttgaagactagctaggaagttagtgtagctaaaatgtgtgagctagggaagagagagtagtattgacaccagcaggatattagatcatgtcacatcttgaaagccaatgtagactctggccttttattcatggtaaaatgggaaaccactagacaatcttttttttttttttttgagacagagtctcgctctgttgcccaggctggaatgcagtggtacgatctcggctcactgcacccgccatcatgcctggctaatttttatatttttgtattttattttatttttttttgagatggagtctcgctctgttgcccaggctggagtgcagtggcacaatcttcgctcactgcaagctctgcctcctgggttcacaccattctcctgcctcagcttcccgagcagctggtactacaggcgcccgccaccatgcccggctaattttttgtatttttagtagagatggggtttcaccattttagccaggatggtctctatctcttgacctcgtgatccactctcctcggcctcccaaagtgctgggattacaggcgtgtgccactgcgcctggccaatttttgtatttttagtagagacaggttttcaccatgttggccaggctggtctcaaactcctgaccttgtgacccgcccgcctcggcctcccaaagtgctgggattacaggtgtgagccaccatgcccacccacaccactagacaatcttaagcacagacgtgataatgatttggcttctatttaggctctatcttttatattaagaagagactgtagaaggggaaaagtagaagcagggtaaccaattaggaggctattgtagaaatccaggtgatagattgtggtgatttagaccatagtagtagtcatgaagatggttagatgtggtcaaattctggatctattttgaatgaagaacctatggaatttgctgacttggattgggtctggggagtgaaagaggagttacggttgtcatcaacagcggatgaggtccaggtatgggagatcttgactatttttggagatctgtgaaaggattgcatgcagcggaagtcgcagcagaggttaagaggattcatctggatacatatggaaatgggaatgtgaagccagagaactgagagtttgttattcagtcctgaactaggatgctgctggtgggaatggaatggaacaatgacattttagagtgatttgataattttacagtaatttaatctgtataaagggcttagtgcttggcagaaagtgtattagctatttttttcattatggaaagaaaccagcacaggtaactaggtgtgtagatggtggagagacagggagaaagtgaaaggaaagagtcaaggattctcctagtctatataaacactgcctcttttgaaggcacacgttcatctgctccaagggctaaattttccctgcaaaatacagactttggttccaactttctcatgctgtcttccccctggtgtggcagataaatatgttagtgggggtgcatgtgtatatgtatgggaaaatgatcagtgacaaggtattgggatagtcattcagggagagagagtcagtgagggtgttagaggtagctgaaggagtggaagggagttagctagttgaaggaacactggaggactgtcggggatttgggggattaagtaaaaggtttataaggagagggtggaaagagtggttgatggctgatattctgatcatttatactagctactcagtctctactttttctagaagtccccagtaaccaaagcccaacacatttggtatcgttgattccttccattgtttgctttgctttgggttgcctaaggctgtggttatctctgagccacctaaattctcaccctcagctgaaatcactactgtctcttcatggctctcagtatatttcaatccttcttcaggaactggagcttttgagaataaggcaactttaggattgaccctaggacagaagctctgctctcaggatccttgtatgctcctgaatatgaattccatagtatgatatttggagctccccagatccttgtaggcatatgtgtgtgtgtgtatttgaggccaaaaaaaaaaaaaaaaagtccctacctccccatgtcactgaagtgaactccagaatatggacctagataatttagagtccctggacatgaatgataggacaatatactctagggctctgattttccatatcaccttgacaaatctccttgacaaaacatgggcttgcctcaccttctcaaccatccccaccttctcaaatacacacactacatctatatctttactagtttcacaacagcatatctattgattaagatatatttggtaaagaaaaacactcattttgagaaagatgacttcagaccattctcttcctctctctgggccttctctttgtgggcatgatgggaaatgaactacagatactctgcaaggtccctttcatctctaatcttccagaattctatgactgtttctgaagagaggaagcagtttttagaagttctgttgcaacctgtagtgactctgtggtgactcagtaggcgggttgaatttctgttgagatggtaagaaagagggaggattttgtttatttatttatttatttaatttattttctataatgatgttgacaccataaagcaagaattttagaaggtttggaatgaaggggctgaggaaggagtctgttcctcttgcctgagggttgtttgtggctggtagcataaatactcaaagctaatgggagatacatgggaaatacctgttgttgggaacagtctttctccacttgaatgaggtgagcagattgtggaggtgagctggaggatttcatgtttaaggtggatttctaacctgcttctctcatttctccctgagttttatgacccttgacactttacagaacacctccctaaagtggtgaaaatgagacaagtaggctgtactttccgagtcactttttttggaagtaggtggcatatgaataataaatgtattgctctgaagactctgtcttgaggcctgtttcagtgtcctgagcttcatatcagctacctgagtttgtgtctgggccaacttcttatactggcatgttcagtaaacatttaatgaaaagaatggctttagttaatgcccttttctaagccttctttttcccacttataaactgttagggatgtacaagactcttttttaagttacttctggcactgaccttcagaatttctgtcacaaatgcagggaactgcctggataaattctctacatttctgggagaagttaggggagaggaggaactggcctcctctcctttgaagatactaggtggtcagatgggagcaggggttcttgccttatggcagccccacatttataacaattaactcagaaggcgtggagttgaggatgggccttcccccacttcctggatttggtttgggagaggttgggcactggtaatgatccccggtgtctcacatcttgaacctctgagaattcaagactctcagtttcagtccttagaggtcatttggtccaattcccacacaaatcaggaattgtagtaccaatatcccaatccctaacaatccccataagttatcattctgattctgggtcattctcattcaattcctacatctctaccttaatacttactagttgggcaagttacctcacctctttaaacctcaattttcatgtctgtaaaatggaaataataagtcctgtgacatagattgttgtaaggaagaattggaataatctatataaagggcttagtgcttggcaaaaagtgtattagctatttttattattatgccaaaaccctatacctaaaacaggtaacagcggtgctgatctggttggagcatggatgggaggcctagagccacattctgtaggcttctccaccctgttactgtgttccctgtgaggtgtgtgtctggaatccctagggatttgcaaagctcagtttgaaaacccctgatctagtccagtgttcttgttttataaatgaagtgatactgagtccacagtctcaggttcctcatatgatgtggcttcctaaacaaccatgtcggtctcccctggatatactttagttggccaatatctctcattaagtattccagctatggtctgacttgaacagggtactattaccattctttcactttacatatctaagattatattagcctcattgacagccacactctccagtcagtttataatctctcataatacttaagattttccttttctttctctctttctctctccttttcctttttcctctttctcctttcatttccttccctttccttcccttgtttgtctcactctgttgctcaggctggagtgcagtggtgcagttgtggcccactgtagcctcaaactccaaggtccaagtgatcctcccacctcagcctcctgagtagctaggagcacagtcatgcaccaacacaatcagcgaattttatttttatttttattttgagacagaattttgctcttgttgcccaggctggagtgcaatggtgtgatcttggctcgctgtaacctctgcctcctgggttcaagcaattctcctgcttcagcctcctgagtagctgggattacaggcacacaccaccatgcccagctaatttttttttttttttttttgtatttttagtggagacgtggttttgccatgttggccaggctggtctcaacttcctgacctcaggtgagcttcctgcctcagcctcccaaagtgctgggatcacagacgtgagccgttgtgcctggccagcttggaattttgaattagagaaggtacaagagaagactgcaaaatctcagatataggagggccttggactacctattatctctttttgggatataaagtttttagaacagccctcttctagggttctaaggtctggtctacttatggttttactatcatggtttattatcatggttaccttatggttttaccatcttggagcatcattattttatttaaataaaataaatacaaccctgaaactattcaccctggaatactttacacacagagttgcccgtacagaaaacatctctagagcatatgaacacctgcatttctaagtgtgatttttttgaccagagactaatttttgaaaccaacgtttgcttctttttgaccatgatattttaatacatgaaaatctatccaaaggagcagtcacagagggttcttgttgaactttagtttctgagctgcttttgaggatggttacttgaggtgtcctccaaactgccacatatagtgagttagagaatctgccaggcacagtggctcatgcctgtaatcccagaactttgggagactgaggagggaggatcactgaactcaggagtttgagatcagcctgggcaacacaggtagaccccatctctataaaaaattttaaaattaggccaggcgtggtggctcacacctgtaatcccagctactcgggtggctgaggcaggaaaatcgattgaacctgggaggcagaggttgaagtgagccaagatcatgccactgcactccggcctgggtgacagagtgagactctgtctcaaaaaataataataataaataaaaaattagctgggtatggtcatgcatgcctgtggtcccagatatttgggaggctgaggtgggaggatttcttgagcctgggaggttgaggctgcagtgagcggtgatcgtgctactgcactccagcctgggtgagaccctgtctcaaaaaagaagttagggagtcctaatacaacatctggatttgttaaaaatctgtctagttgttttcatatgatgggaaacaaactgacagaaatctaattttatttatatggatagccatgctgtacttgctaagaccacaagaataggctcagagagaggggaaagtttgtgtaaattatacattgaattaggggtaaacaatctagtctgatgactccatattcagagccagggtttcccaattttagtttatgtaaataattacctgaggatgtcgttagaaatccagatttctggaccctatcccagactattgagttagaatctccagaggataagacctctgacttgtatttttgtaacctcctcagacaattctgatgttggggggagggacaaagtaccattgaaaaattatttagattaataaccttaaactcttaaaattatatacctaaaagaattttgaaaaattatgtaactcttgacataatgttcatatctaaaaattttatcataagatttaaaaattgcaaaaaatcgaatttccaaaacattttacatattatatacacacatatatatatatgcacatataggttatacctctttcaaaacattggcactgcaaatttagctcatataatttatagaagacatctaccatacaacctgttttgcatagccagttatcacccaacataatcagccaaatcagatctactgtgttagaaattgcctaacttctttcttaagataaatatgttaatatatgactctgtgataactgtttcacttctgagttgtaattctaagagatataaggcaagtagtcttgccatgagtttgttacgtggatgaattaagatgccaattctttcaatactgatttctcagagaagctctcattgatttgctttcttggggctctccctcagaagttatacattctcaaattgtccctttgtttaacactttgttcataccctgtcattgtaccataataaagtttgagataagagagagctatgacattcttgtttaacgtgggagaagggtaattgtaaaagagagtgagaaagaagaaccaactcagacagatcattgttaggaaatattacatatggaagttgaggatctagacatttattctcttcatatttttctgtgcaggtactcacaggaatagagtaccgtagattgaggactaatgatttaaactgcctttgacctagataatagagaaccattgtaatgaatatttttgcatgtgtctattatacttgagagacttgatgtacacataaaatgatgcccctggattttctttccactttctgtttctgctctaggcatattcctcttttgggctgcattccaaatgctctgccctcattcacttgttataggtaaggccagcatgggacacaggatggtaggaacaagtgtgtgattcccctcctgtaagtaggcatgtaggcagtgagaaaagagaagaggtacacaatccatcgggcaccaaagccactttggccaaggggaacatgcaaaaggtatttggatcaaggcctgaaaatagctggcaagaggacagggtacaataatagcccagactgcagggcaggagtcccatactctgaacctcagctccagggttctcttccagcctcttcacagagtcccagactgagcccactgtaggatctcaagaaacacttcttgacatgattccaaaatccattccacaaattccactcttgtctttcctctgcctgtccagcatctatcttgtttatctgtatcctatcttatcccctctccttccatactttctctctttgatcatcttggatccagctggtcatataagcagagataagtttgttcatttatttattcattcttttatctattcattttacaattatgtattaagtgctcactgtgtattggcctttgtggtaagcactaaggagaaaacatataaaaagatatcctgtctgccattaaggaactcataatccagtgagggaaacagatgtctacataggactctagtgctagaaaaaaataagtgcccaagtgttgtctttagaaataaacaggctgggcgtggtggctcacgcctgcaatcctagcactttgggaggccaaggcgggcggatcacttgaggtcaagagcctggccaacatggtgaaaccctgtctctactaaaaatataaaaattagcctgtggtggcgggggcctgtagtcccagctactcgggaggctgagacataagaattgcttgaacccgggaggcggaggttgcagtgagccgagatagcaccactgcactccagcctgggcaacagagctagactgtctcaaaaaaaggaaaaaaaaaaatagaaagaggcaagaatgaatgaatgaatagtgcttaatctttctaatgaatgaatagttacaacctttctggaaaggaaggtttgtaaagatgtctgtattttccaaattaatctgtacatttattgcaattccaatcaaaattgcaattatattttttattgagatataatttataccatataattcacccatttaaagtatacaattcatatttttaatatatttgcaaaggtgtacaactttcaattttagaaaattttcatcacccccaaaagaagtgcaatactcattagcagtcatttttcattttcccccaacttcttctcctccagctctaggcaaccactaatctactttctgtctctaaggctctgccttattctggatgtttcatataaatggaatcatataacacgtggccctttgtgtctggtttctttcactaagcataatgttttcaaggttcatccatgttataggccggatgcagtggctcatgtctgtaatcccagcactttgggaggctgaggtgggtggatcacctgaggttggtggatcacctgagcttggcagtttgagaccagcctggccaacatggtgaaaccccatctctactaaaaatataaaaattagccggccatggtggtgcatgcttgtaattccaggtacttgggaggctgaggcaggagaattgcttgaacccaggagacggaggttgcagtgagccaagatcatgccaccacactccagcctgggcaacaaagtgagactgtcttaaaaaaaaaaaagttcatccatgttataccatatatcagtacttcatccttttacattgctgaataatgttgcattgtataactgtatcacattgtgtccggaattggtgggttcttggtctcactgacttcaagaatgaagccgtggaccctcacggtgagtgttacagctcttaaggtggcacgtctggagtttgttccttctgatgttcggatgtgttcggagtttcttccttctggtgggtttgtggtctcgctggctcaggagtgaacctgcagaccttcacagtgagtgttacagctcataaaagcagtgtggacccaaagagtgagcagcagcaagatttattgcaaagagcaaaagaacaaagcttccacagtgtggaaggggacctgagcgggttaccactgctggctggggcagcctgcttttattctcttatctggccccacccacatcctgctgattggtagagccaagtggtctgttttgacagggtgccgattggtgcgtttacaatccctgagctagacacaaaggttctccacatctccaccagattagctagatacagagtgccaacacaaaggttctccaagtccccaccagagtagctagatacagagtgtcaattggtgcattcacaaaccctgagctagacacagggtgctgattggtgtgttcacaaaccttgagctagatacagagtgccgattggtgtatttacaatccctgagctagacataaaggttctccaaggccccaccagagtagctagatacagagtgtccattggtgcattcacaaaccctgagctagacagagggtgcagattggtgtatttacaatcccttagctagacttagaggttctccacttccccaccagactcaggagcccagctggcttcacccagtggatcccgcactggggctgcaggtggagctgcctgccagtcctgcgccgtgtgcctgcactcctcagcccttgggtggccgatgggactgggtgccgtgagcagggggcggtgctcgtcgggggggctcgggccgcacaggagcccacggtgggggtgggggaggctcaggcatggcgggctgcaggtcccgagccctgccccgcgggaaggcagctaaggcctggcgagaaatggagcgcagtgctggtgggctggcactgctggggtacccagtacaccctccgcagctgctggcccgggtgctaagcccctcattgcctggggccggcagggccggccggctgctccgagtgcggggcctgccaagcccacgcccactcggaactccagctggcccgcaagctccgtgcgcagccccggttcccgctcgggcctctccctccgcacctccctgcaagctgagggagccagctccggccttggccagcccagaaaggggctcccacagtgcagcggtgggctgaagggctcctcaagtgccgccaaagtgggagcccaggcagaggaggcgccgagagcgagcaagggctgtgaggactgccagcacgctgtcacctctcaacgttatcacatttttttctttctttctttctttccttctttctttctttctttctttccttccttccttccttccttccttccttccttccttccttcctttctttttctttcttttctttcttttttgtttttttttgagatggagtcttgctcttgtcgcccaggctggagtgcaatggcatgatctcggctcactgcaacctccgcctcccgggttcaagcgattctcccacctcagcctcccgagcagctgaggtacaggcactggccaccacgcccggctaatttttgtatttttagtagagacggggtttcaccatgttggccaggctggtcttgaacacctgaccttgtgatccacccgccccagcctcccaaagtgctgggattacaggcatgagtcaccacacctggccccacatttttctttattcattcctcaattggtggacatttgggttgtttacactttctgatgtcatgaataacgctactacaaacctttgggtacatgtttttgtgtagatgtatgttttcaattctcttgggtatatagctaggagtttaattgctgagtcatatggtaagtctatatttaacctattgaggaactgccagactgttttccaaagtagctgaaccattttatattcccggcaatgtatgaggtttccaatttctgcacatgcttgtcagcacttgttactgtctgtttgtttgattatggccatcttagtgagtgtgaagtgggatctgattgttattttgatttgtatctccttgaccatgcctgaccttttttttttttttttttttttgagactgagtctcgctctgtcgcccaggctggagtgcagtggcacaattttggctgattacgacctctgcctcccaggttcaagagattctcatgtgcagcctcccaagtagctgcgactacaggtgcgtgccaccatgcccggctaaatttttttttttttttttagtagagatggggtttggccatgttggccaggctggtgtcgaacttctgacctcaggtgatcctcccaccttggcctcccaaaatgttgggattacaggcatgtgctactgcacctggcccattaactgccttttgaagactggccggtacagtcctggctccctcaataggtgaggaatcaatgtttagggagaaatttcataaatagtccactgattgaggctatttactctagtttcatcagttttgagttggtgaaaagcccgtccaaatttgggtgataggatgacagttgattccagtttttgaatcaggagctgagtgaggctgcattagggtctacaagttagatatcatttgaaaccagaaatctgtggtgttttcaaaaggaactttttctaaggaactaagggaaaaccaaacagaatgatgaatttctgttaagtacactaaaattccatccttggtagttgtcaacctcacagttctcagagttcctacatttttatttttttccttatgctaattctgaatttggaaacaataccccccttttggaggccatgtcatttaggaggagaaggccctgaactagacatttagactcaagaactgtgctatccaacatggaagccactagctacatgtaactattgatatttatagtaattaaaattaagtaaaataaataatccagttcttccgccacatttctagtgtttgatagctatatgtggctagtgactaccattttggacaacagtgctttagaatagtgttgctactaatttgtaagtaaccttgaggtcatcactttctatttctgtgccataggtttctcaatggtaaataagagtggtgagtctcaaaagtaccatcctcttctggaattctttctttttctcttttcttttctttctttttttgacaggatcttgctttgttgtccagtctagtctctaactcctagcttcaagtgatcctcccacctcggcccctaaagtgttgggattacaggcatgagccaccatatctggccctcctctggcattctgagtaatctgtggttcagtttttggggtgtgcctccatctacctcctccttcagcccttcttgatacttactgcagctagggcagaagcacccagagggaacattaggctgctaattagtcaaggtacattgctcccattccctggtgaaagggaaattgacttgtgggtatacttatatcttgagtgctccacaattgtgcagtgctttatggatcacagaactctttcacattgttttttcattttatagaatcaaagaatctcaaagttggaagggctgtaaaggtcatctcaaacttcaataaccatgaattatatggggagcttatgcaatgaaaatttcaaggccccactccctggagaataatctagtagaagtaggtgtcagggttaccctggcccaacctgaacaatcctgtgctgcatgggaacttggtactgcattattaacactatctgaccactctttgagaaacactggtcttgcttggtccccagccatattgtggaggctgctctttggtatcgctacaaatcccagattcaacatgatatctccagggtcaggaaactcctgaaggagtgccttccatctttggacatctctaacagaaaggttttttttttaatatggagctctcccaattgatgtagattttccatttatagttatactacattagtctacttttccccataatgatcctttagattcatgcattcattcagcaaaaatttactgaacacctattatatacaaggttctgtacgagacaatgagggattcagcagtgaacaagaccaacttggcctctgccttcagaaactgtcttctgtctagtagggaagataggaaattagcaaaaataataataagtaaacaagtaatattaattctattaataatattaacaataacaataagtaaacaaataacaaaagaagtatagtttgagaaaaatgctgtgaagaaaataagcagtgttatgatgaataacaagaagagctgatctacttagggtggtcagggaaagcttcactaggaagtgacatttaagctgagatttgaaacacaagaagagttggggaaagatagttaaagaatatggcatgttctatcagtcagaaggccagcatgtttggagcctagtaggcagaataggagaatggcacaagatgaagttggggaggatacaaggcatagcaggagtgcggattttcttctatatgcagtggaagctgttaaagggttttaagcaggaggtgatatgatctgatttgtggtttgttttattgttgtttaattaattaattaattaattaattaattttgagacaaggtctggctctattgccctggctggagtgcagtggcaacatctcagctcactgtaatctccacctcctgggctcaagtgatcctcccacctcagcctcctgagtagctgaaactataggcatgtgccaccacacctggctatttttttttttttttttttttagtagagagagcatttcgctatgttgcccagtctggtctcgaactcttgggctcaagcaatcctcccaccttggcttcccaaaatgctgggattacaggcatgagccaccatgcctggccaatttatgtttttaatagatcattctgtggccgggtgcagtggctcatgcttgtaatcccagcactttgggagccaaggcaggcaaatcacttgaggtcaggagttcgagaccagactggctaacatggtaaaacttcatctctactaaaaatacaaaaattagccaggcatggtggcatgcacctgtggtcccagctacttgggaggctgaggcaggagaatcatttgaacccggcaggcagaggttgcagtaagtcaagatcacaccactgcattccagcctgggtgacagactgagactctctcaaaaaaaaaaaaaaaaaagatcacagatcatgctgggtgatgtgtggactggaagggaacaagagtgaagtgggaaaccagttaggtgggcattgtggtcatccaggcaagagatgaaggtagcttgaccggggtggagacaatgaagatacagatttttgagacttgctatcacatctctcaatatcttctcttccacaaaataaacagttcagtgttcctctcatctcctctcataacaggtttggtgtctcttctcacctgggtgtttctcctcctgtttctcctccatctgattcctctgtaaagaactcagtctttccctcagctgtttcttcctatcctgtgccttgcttgtagttctagggaattaaaatcttcaattcaatgactatcgttctcatataaagaggggagctgggtgcagtggtgcatgcctgtagtcccaactactctggaggctgaggtgggagaatcatttgagcccgagagtttaagaccagcctgggcaacatagtgagacattgtctcaaaaaaaaaaaaaaaaaaaaaagttggggggtagcaccagtcttccctgtcattagtcaattaccagtctttcaattattcaaccatgaccctcgaatacctattgtgccaattgtgcttggaggagacagagaagaagacatgatctctgccctccaagagctcagggtataatgggaaagataaggcccaaataaatataataaaagctagaaaaacagatcacaaagaaagtgagataaagggctttgggaggaagaaagaacttttagcttttgggtaggtgagaaaaagagaaactaacaaaaatttcatggaaaatgttaattcagagaacctggggctggagaggagcgcagggagtatttttttttttttaatgtggtgatcaaagataaccttactgagaagccaacatttgagcaacgactcaaagatagggaataagtcatgtggctatctagggaaagaacattccaagtagagggcaaaggctctgaggttaaatgttcttggtgcttttgccaaacactggggaggccgtttggctggagcagagggaaagggagaggaagagagaatagttgtatgtgaggacagagaggaaatgagggactagatcatgtaggccattgtgaggactttgacttttactcaaaatgaaatgggaagtgatctgagcattctgagcagaagggtgacataatctgaactacctaatggtagttttggactaggatggtagaaatagatgtgaagagaggtagtctaattctaaatggattttgaatcaataatgggttaaagtaaatttcgagagtgtgagaatgaagtagttggagaagactccttggaggaggttccctaggggaagaagatgagaaggactagtgactgtgtaccatgggttgtcacaccaaccatatggcctccaggtgaaggaaaagtagtttggtttataccaagggttccccatgttatcccaccagctaaatttctcattaatagttttgtttgattcacagtgtttaaaccttttttttttttttttttttttggtaggcaggggcgagacagggtctctgttgctaggctagagtatagtagcatcaacgtggctcactgcagccttgacctcccgggcttatgtgatcctcctattttagcctctcgagtagctgggaccataggcattagctaccatgcttggctaattataaaattttttgtagagacaagttctcaccatgttgcccaggccagtcttgaactcctgtcctcaaacagtcctcctgctttgccctcccagagtgctggtattatggcatgaaccactgcaactggccttaaagctttaaaaaaattagtggtcaacacatataaattcagaagttttttttttttttttgagacggagtctcgctcggtcgcccaggctggagtgcagagtgcagtgcagtagtgtgatcttggctcactgcaagctccacctcctgggttcacgccatcctcctgcctcagcctcccgagtagctgggactacaggcgcccgccaccacccccggctaattttttgtatttttagtagagatggggtttcaccgtcctctcgatctcctgacctcatgatccgcccgcctcagcctcccagagtgctgggattacaggcgtgagccaccgtgcctggccaattcaaaagttttgacaaaaatagattccaggctgctattgaaaaatcgaaaaaattgacaacattgagccctgattcctagcaagcaaaagctgacaggaaccaagtttaggtactagatgcctccttttgccagagcatgcatttgccagttttcctgtccttccccttccctattgttcccctgaaactgaggctaaggtttattatacatgtgctgctgttttcttatagggaagtggaaagggaactatttcttatctttatcatatattttctttcatgtggtccacttatttacattccgtgcctagatcctgccaatttttgagcttgcagctcctggtgtagaggaaagaggcctggaccttaagtcgtggtccctgctctgctgtggtaacccaccctgtgatgccaagcatagctaatagcctctttggatctcagagttaagagactaaattggatgttcttttaagagttctgatatcctggccgggcgcggtggctcacacctgtaatcccagcactttgggaggccgaggcgggtggatcacaaggtcaagagattgagaccatcctggctaacacggtgaaaccccgtctctactaaatatacaaaaaattagctgagcgtggtggcaggcgcctgtggtcccagctactcgggaggctgaggcaggagaatggcgtgaacctaggaagcacagcttgcagtgagccgagactgcggcactgcactccagcctgggtaacagagcaagactccgtctcaaaaaaaaaaaaaaaaaagagttctgatatcctagagggcttgggattttgcagtaggccaataccctgcccctcacctttcccaaccagccaggggccccagcctggtgtgtatgtcagagaaagaagacactggaatgagtaaggtgcttatatcaataatgtataacttgagcccatagccaaggagaggaatgcacactgtggtgtgtgtgtgtgtgtgtgtttcacggttggaagtgggctcaaataagttgtacttgcataggttgtgcttatttcttcttgtgcactctctatgtactaggctgtacttgaggtgctagggatgtagcagtgaagaaaacaaataagatctctgctgtcagctgggtgcagtggctcacgcctgtaatcccagcactttgggaggccgaggcaggcggatcacctgaggtcaggggtgtgagaccagcctggccaacatcttgaaaccccgtctctactaaaaatacaaaaattagccaggtgtgatggtgggtgcctgtaatcccaactacctgggaggctgaggcagggagaattgcttgaaccctggaggcggaggttgcagtgagccgagatcgcactattgcactccagcctgggtgacagagcgagactccatctcaaaaaaaaaaaaaaaaaaaaagatctctgctatcatggagcttatattccagtgaagaaaacagataatatataagtaattaacatacatgagataatttcaaataatggaacgtttcatgaaaaaaataaaacagaatgtgttttttttttttgagacagtcttgccctgtcacccagggtggagtgcaatggcgcaatctcagctcactgcaacctccatctcctgggctcaggtgatcctcccaccacagcctcctgagtagctgggtttacaggcatgcgccaccatgcccggctaatttttgtctttttagtagagttggggcttcgccatgttggccaggccggtctcaaactcctggcctcaagtgatctacccacctcagcctcccaaagtgtgggattacatgtgtggcacctggcaaaacagaatgatttgatagagagtttctgaaggggcacactgtgcacataggtggctacatgtatatggtggttgtacttgcagatacagataagtccatgtttgaatcctgggtgcatatatttatccttgtttgtgcctatgtgtgcagatgggcagcttttatgcctagaatgtttgtatatttatatgtgattttatacaagtgagcgcacataggtgagttggtatgtggtttgcatatggggacacatgtgcttgggtatgtatatgttggcattcagccataaccggagacgttctgaagttcctgtggcacttgtcagtgagccagttaaggaaatggcttttctgcctctggcattcagggccgtttgccagcttcctctctccctgttctttcccactttagtaagctccctgtgtttggcttctctcatccctaggagggttaaagcctactgactcatcgagccaggaactggaaaaaggctgataatcttctgtgtgacctctgttagtaagaaaaggcctggcttccctgccagtccctgtccttcacactatgagggagagtcctgacttgaaatcagaagacctgagcatctattcttggctctgccacttattattgtgtgaccaataatctctctaggtttcagttacctccttcataagtgctctgtgcagtaaggaaggagaggggaagcaatggtctgtggtgctaagggagagccagatggtgctggtgtctgaaggaggagggagaatattctgagcaggggcaatgatgtggccaaaagcgtggaggtggacctgaacttgccaagggaaaccagggatccacttacagtaaaattcaaacttcttactattgcctacaaggctctacgtgatttggctgctgcctacctctcattcttacccaacttcttgctcactgaaatctagccatactgtctttctttctttctttgaaaaggtctcagtgccttttcacttgatgctccttttccccagaatactcttcccaagaattagtatgattgcctacctctcattattcaggtcttggctcaaatatcacctctccagagagaggccttccaggaccatcttatttaaagtagttgttccctaatatttatcaatatttaaaatgcacacatcagccaggcacggtggctcacgcctgtaatcccagtactttgggaggccagggcaggtggatcacctgacgtcaggagttcaagaccaacctgaccaacatggtgaaaccccatctctactaaaatgcaaaaattagccaggtgtggtggtgcacgcctgtaatcccagctactcaggagtctgaggcagaagaattgcctgaacccaggaggcggaggttgcagtgagccaagatcgcgccattttactccagcctgggcaacaggagcaaaactccatcttgggaaaaaaaaaaaaaaaaagcacacatctcttgaaccaacaggtccacttctggtaattcatcctacagatatacttgcaggtgagtaaagtgacataaaaataaaaatattcattgaagcatttatttgttaaataaattacagtacatacaaatagtggaatattttgcagctgagaaagataatgaaatagctctttaagcttggcaccgtggctcacacctgtaatcccaacactttggaaggaaggctgaggcaggaggattggaggatcacttgaggccaggagttccagactagcctgagcaacatagtaggatcctgtctttgcaaaaaaaaaaaaaaaaaaaaaaaggtagccagacatggtgactctggcctgtagtcccaactgctcaagaggcagaggtgggaggatcacttgagtctgggaggttgaggctgtagtgagctgtgatggtgccactgcaccccagcctgagtgacagagtgagaccctgtctcaaaaacaacaacaacaacaaataaaaaagagaaatagttctttaagtcttggtgaagaatgatatcaaggtatattgttaaatttgaaaaatcaagatgatcaatttctacacataagatttgtgcattttattgaatgcatataataattaacaaaagatacagaatagtgtgtattgtatgccatcatttgtgtagaaaaaatgagactatgtaaacaaatgcatgtagtatatatgcttgtctgacagacctgtcccttaagtagagcagttcttcctacccctgttaccctgtgcttgactggggactatgaggtgttcatctcttttctgaacaacattaaaatccttttttttttttttttgagacaaagtcttactctgtttcccaggctggagtgcagtggtgtgatcgccgctcgctgtagccttcaccttctgggttcaaatgatcctcccgccttagcctcccaagtagctgggactacaggcgtgcaccaccatgcccggctaatttttgtatttttagtagagatggggttttgccatgttggccaggctggtctcaaactcctgaccccaggtgatctgcctgccttggcctcccaaagtgctgggaatacaggtgtgagcctctgtgcctggccaaattttttttttttttttttttaaacagagtttcactcttgtcgcctaggctggagtgcgatggcacggtctcagcttgctgcaacctccatttcccggattcaagcgattctcctgcttcagcctcctgtaaaattcagttttttaacattcaattttcaaattttggtcttcaatgatatctcaagggtcttattaaagatcataatgatacagacttcttgcaaagtaattattttggtcattccacactagttgaattaccctagccctgtgtcctacaaagaatggtcctgtctgaatattgattgtttctggaaagtcacacagaatattggtaactgttttgccctgggcatggtggctcacgcctgtaatcccagcactttgagaggctgaagcagttttgcttgaggccaggagtttggagaccaccctggacaatatatcgagactctgcctctatgaaaaattttaaaataaaaaaattagccaggtgtggtagcatgtgcccgtagtcccagctactcaggaggctgaagtaagaggattgcttgagcccaggagttggaggctgcagtgagctatgattgtgcctctgtactccagcctatcaatagagtgagaccctgtctctaaaaaacaaatcacaaaacccaaactgtggtttgccagtaggcagggtgattgggagataggagtggggagaacacttctcattatgtatctttttatgtagtcccacttgtatgtattacttattcaaaaaaatcataaaattggaaaaaaaccactaagggaaacatttatttatttattttttgagacagggactcactctgttgtccaggctggagttcagtgacatgattacagctcactgcaggcttgacctccagggtacaagcgatcttcctgcctcaacctcctgagtagctgagactacaggtgtgcaccaccatgctcagctaattgaaaacgatttttttttttttagcaatgaggttttgctgtgttgctcagattggtcttgaactcctggtctcaggtgatcctcctgccttggcctcccaaagtgttgggattacaggcatgagccaagagatcttcccatctcatctttctgagtggctgggactataggtgcatgacaccacactcagctaaaattttttttttttttttttgagacagagtttcattcttgttgcccaggctggagtacagtggcacaatcttggcccactgcaacttccgcctcccagattcaagtgattctcctgcctcagcctcccgagtagctggcattacaagcatgcactaccacacccagctgatttttgtatttttagtagagacggggtttctccatgttggtcaggctggtcttgagctcctgacctcacgtgatccacctgcctcggcctcccaaagtgctgggattacaggtatgagccaccgtgcccagccggatccagctcaatgtttttagagatgcggtcttgctatgttgccaggctggtcttgaactcttggcctcaatagatgggcccactttggcctcctaaagtgttagaattacaggtgtgagccaccgtgcctgacccaagatagtatattttttaaaagtatttctccctagtcactcatttttatatcattctgctctatttataatgcttatcataatctgaaattatcctggttatatttgttatttgtttattacccacactatcattggaatataagctccatgatatcaggtatcttacttatgttgttcattggtgccttatttcttcttttttttgtttgtttgagacggagtcttactctgtcgcccaggctggagtgcagtggcgtgatcttggctcaccacaacctccacctcccttcaagctattctcctgcctcagcctcccaagtagctgggattacaggcgtgtgccaccacacccagctaatttttgtatttttagtagaggcatggtttcaccacattggccaggctggtctcaaactcctgacttcaggtcatctacctgcctcagtctcctagtgtgttgggattacaggaaagagccaccacgccccgcccattggtgccttatttctatacatgtagatagcacatagtagttgttgaataagcaaatgaatgcatgaaggaatgactgaagtaaaccaggctaaagcctaggaaggagtgggaggcaaggctgaggaggtagacagaaatcacctgataaaggatggcgattctcaaactttatttatttattcaagatggaaactcactctgtcatccagactggagtgcagtagtgtgatctcagctcactgcaacctctgcctcctgggttcaagggattctcgtgcctcagcctccccagtagctgggattacaggcacacaccaccacacccagctaatttttgtatttttagtagagacgcggtttcaccatgttggccaggctggtctcaaactcctgacctttgatctgtccaccttggccttccaaagtgctgggattacaggcgtgagccaccgcgcctggccaattctcaagaatcccctactaattccttgtaccatcttgtaataaagaagcagatccttggaccctgtgattctaattcagtatgtttgagctggggcccaggaatctacaaatcctctagatgatttaggcacaagtgatctggagaccctactctgaataatgcagtcttgatgcctcatcagaaggaatcacatctgtgatttcacttctccttaatacattactaggatggaagagaaggggccgtcactccatttcatcaaggatcagagatggacagtgcattttctaatgacatacaacatgtgtataaaatatcttgaatggccaaagtatctgacccgtcagctcaagattggtgatggcaagattgatggtgggcagatagctcatcctcatagaacagttccaggccttagtgtcactgaatggattttatgactctgcctgtttcttgtttggggaagaagttatacccctaatcactggttctttctggtatgtctcagggagggcaatgagccaggggagaccactcagatcacataccatcagcttctggtccaagtgtgtcagttcagcaatgttctccgaaaacagggtgagtgtgggggtgtgggaaaggactgggggtctggccttggggtatctgagtatctgagacttatggggagagggcaagggatggaaagaatttggtaacagaggaagagaacaggtcagctgggagggaggccagctggatgggagggagcaagtagcagcaagaagggttcatggttcatattctgtgcttttacctgcaggcattcagaagggggaccgagtggccatctacatgcctatgatcccagagcttgtggtggccatgctggcatgtgcccgcattggggctttgcactccattgtggtaggagtttgggctggtgaaaaggggcaggcgggggggtggggctctggagaagtaggttgggcctagatgatggagggtcttaaataacaaactaaggagcttagaaggtttgtgtcataggtccatattagttattcagtttcttctaggaccctggcttagagatcctgaaagttccatgagcaacccctttcttcattcactcaatccctggggctttcttctctccctcagactttcttcccttccctagtttgcaggcttctcttcagagtctctatgtgaacggatcttggattccagctgcagtcttctcatcactacaggtgactaattctctcacctcttctccagaaccccccatacctcaagccttggtctccaatcagctcattggtatttggggctactcagcatagagggtagagactgcctgccttttctctcctggtcccacctcagctgaccctctgtcagctcgaatcagctggaagagccagagttaagaggcctactcaggaagggccctatggacattgtgcccactaggcagcatggggcttactaaggcctggaatgtctgttgctccccaaagatgccttctacaggggggaaaagcttgtgaacctgaaggagctggctgacgaggccctgcagaagtgtcaggagaagtaagtgtgtttggctactgtctgagttgactgagcctttccccagtgccaggttccctttgtcccctctaccctaaatggacatgggtgggtcttgccaagttccctttgagccaacaaggctaccactttaggcttttctcttctccaggggtttcccagtaagatgctgcattgtggtcaagcacctggggcgggcagagctcggcatgggtgactccaccagccagtcccccccaattaagaggtcatgcccagatgtgcaggtgagtctggcactgctatgcctttctccaggctcaaattccttcacttttcctgcctagaaaattcttgatgtccttctttgcctgctcatcagtatactgaggatccaggagcaattctaggaatgcctcctctagcagggctaggtgggaactggaagactttgaccttgactgtgggtagagaggcccttgtaccttgagaacatagcacaagcgattgtaagggagactcctatgctggttggggtatccttgtgggcacaggggatcctcagggcctaggcttgtgttagaaatgtctaacttgagtgacaatatatagtcatctccattactaggctgtgatgtggggtgggctatctttgtggcctaagggatgcccaccttggaaggaccagagtccagccctcacaatatggcctttgttagctttggacccccaggcttctggtgggaatggtagaaatgcccagtgatggcctccaggctgagcagcatgagggatcaaagttctggggttgagtaagagtctgtgacttgaggctccctgaggggtcttagggctagagaggctgtagtctagtttagggaagttggaaagcccaatcagtgttaggggttttacatatataggggctggaatcaggatcaggaaaatggaagctgggaggaccagtgagaagggagtttggggtttatgacacactgaccctttcctcccactccctgtatacttggaccctcctcactacccttttcatcctgggctcttaacagggtaaactgaaagagaaatccaagcgtgttcagccccaggtatccatttctgcactgccgtgggcaccgcttctctgtttgcttgtctgtgtgctcatctgccctttgcctgtttgccccattgaggtggctgccagacctaacctccttccccttgcccctgggcaacttgacatctaagccactgaagggtggtgaaattaaatgtccgttactgcctctgtgaattggtatagagtatggatcttagagaggtaacagcagaacacattttatcctgatactcaggacctttgtgggagaggggacaaggtaacctgtcagaaaacatttactgtgcaggtagctggagcagagccgagagacaggaggaggaggaggtggaggaggttcagaccctgactttgggaattcactgtcaagttggggagttagacatgtattattaatacaaaggaaaatctaagttttatacaggacagcagaggagattcctaaatacatttatatagtgctttgggatttataaactgcatataactttgtaatatgattaagtgctaaactgaacaaaagtcatattgtaggtggttctaagaagggagatccataagggggtgctcaaagcagattagtatcgaggaaagagtgggcctgaagtccagagaccaatttttagctgtatgaccttgagtaagtcaattctcccctctgggattcagtttccttatcagtaatggagagatgataacacatgttataaaaggaaacagcttcccttcctaaaacaacacataaagctcactattcctctggattttaccatcttcacagggtgtcttactctaaatctgctatgattaacctcttaggccaatggtagatataagccccttttctctattctcattagcatggcggagacagatctgattcctagggcatactgctttccttttaaaactcaggcaggacctacaccctttcttttgaaagaggtgacaaacttagtggcttaaattgtaatctctggagccagattacttgggttcaaatcctggctctgccatctgctgctgtgtaaacttgaacaaattacttaagctctctcgcttgtttctccatctgtaagataaggataataattatacctatgttatcgggttttgtcaatatatgtaaggtgtttggcacatagtaactactcaataaatgttagctgttttttccttccccttaatgcaacagacagattggcatttctaaaacagagaccagaaaagaaataacaaactcttgtaattcttaataccagagaccttcaggccaaaggctactggatttttgtttcttggaggtgaaaataaccagtttccaaaataccaaagagcataaaaataggcttaaaaagtccaggttgttggtctgagaattgcagtcaaagctgcaaaaatctttctgacaatgggccccatatttaaaaattaaaaaatagttttcaaaagagctgcaaaaatcctggcagggctccaaacccctttatccttaaacaatcttccagggagatcctggcagggtttgcagggaccctcctcaaccatatcgtctatgagctccctcatattcctctcccgtacatggcagctgccctccttgagactatcctggtccaaggacaaaggccaactcctcaattcttattttagaaaattcagaccttttcctggtgcagagcctggggcctcataggcacacacctaattcacaatcaaaggttgctttgctaattgagttcactctgcttcctggtgctagttatcagttccacacctggagtactctgacccctccacctctatatacacacccacccacaaaagaaataataagattataagagtgccctcattgcagagccacagttgtaactatgccttgtccttacatgtacttagtgcctgttctgtggcagttcacagtgctgtagaccagcaccatttgtccaaagcagtattgatacttctggttgaataccttagtgcccccatctcaagtgatcatttggcaggaaaaaaagtacccatgtgacaatgtatgtgtagatgcatatggatagaccaaatcaggtgtgttcttatgttttctaaccgtaggcagctttctctctcttcttcctttttctaggcttgtcgtttttatgatgttgataatccagaaatttcaaattctctaccataaggggcaggtggtacagaaagaacggagtggttagagagtcattttctaatttatcaagctatatatctaacactccagaagtttttttaaccaaatatgcacacaacaaattagcatatatccttataatgggagaatggcatttatcttacaccatcatgtctacctgccagccagggccattgaacatacaagaatctaattaatatgaaaggactttgtgacagctaaagcaaaccccaaacagttcctatcatcacactcttaagtttttgtgggttttttttgttgtttttgtttttgtttttgttttttgagatggagtctcactctgtcgctcaggctgaagtacagtggtacgatctcggcttactgcaacttctgcttcctggtttcaagtgattctcctgcctcaccctcccaagtagctgggattacaggtgtctaccaccacgcctggctactttttgtatttttagtagagatgaggtttcaccatgttggccaggctggtcttgaactcactcctcacctcaggtgatctgcccactttggcctcccaaagtgctgggattacaggcgtgagccaccgcgcccagccccacactcttaagtttaactcccagtagtcactgaactaacctctgtctctcctgacattcatcagtcttcctcatctcaccccaacctctacccttggggcaatccaaggcttgatgtttactagataatacttttttcttttggtgtttaccacatcctgtgagtctgttaaggcaagaatgactgtcctcatttgtaaaaggagagacttaaggtaaagtgatttgcccaaggtcatatagctaggaagtggcagaactggtattgaagtacactgaagattttggacaaattcaagggatctaacttcattcagcagatggtagactcaaaattggtgttcaaagaggtgatatagacagaaaagtaaaacagtttcaaaggagaatttagagaagtttcaggatgacagatccagaagtaattatcaaaggcatagggggacatccttctactgggagaagtccaccttggtccttcttcaccaacttgaagcaaagcttcctgctgaatggaacctgtcccctcaagcaaaagtctctatgggaaaccctattggtaccagtggtgtaaaggcaggagcagagctagggtaggaaacacgcagatgtggattgggtctggacatgtaggcaaaagtgcttggaccaagatctgttgacttattttactactaacagggtcaggtgcccacctcacctgtaagctctgactaattttgcatttctgaattgtgtggtgtccgcatccctgctaatgagcctagtcccataagtacatatgtatgtatgtagacctgtgtgtgcatagtcattcatccaacaaaaattgactgagtgccaggcactttgctaggtgttgggagatatggcaggggtcgggaggaaagacatttcacctccttcatagatgtcgctatctagatggggagacagtaatcaagtagacaactaaacaaaataacaggaaatatgtactgtgtgggaaagaaacatggtgttgtgatcaataataatagcagggttgggggtagcaatctatcagatactgttcaggtaaaggctttccaagaaggtgacatttcagctcagaattgaaggatgggaagggaccagccaagggttcctcctcagcctgaggccaggtgagaggagttctggggtagagatgggggtaggatggcagggtggttggagtactcagtaagcttgggttctgctcctgttctttctgttccattccatccttgaagggccttctctcccttcctgtactcctacctgcctgtcccacctcattccctccaggggcaaggtacgggtgtatcttgtccccatcttgagctgttcacagttcttccctgcccatccctgcagatctcatggaaccaagggattgacttgtggtggcatgagctcatgcaagaggcaggggatgagtgtgagcccgagtggtgtgatgccgaggacccactcttcatcctgtacaccagtggctccacaggcaaacccaaggcaagtgtgtgtgtgtgtgtgtgtgtgtgtgtgtgtgtgtgtgtgtgtattatgtaggggtaagaagtaagtttctgaggaaacaagtaatgaaattatttttttcctacaaccctgagttttggaaatgtagcattgtcttttctaaatcaaattaagacataaatcctcaatctataggtggtgaggcccagggtgagacagttcaggtggagggttttcatacagctgacatggatgttctttccctatgcacccatggtttggttgaaggagagctattctgttaactcaaggccaagggtgggcacagagatccctctcaggcttctaagaccataactcttagagttcaattccttccacctggcacactattaacatgtagtcctctgccagcacacaccatgggagccggaaacacttaagaaaactgtttcttccattgacttgaaagctatgtcactctaccttctgcccactccacccctaaattatctccatatgctttggaatatccctcaataagtctttagaaacacaattttggcctctctttcatagagatgggggtagggatggaataagcaaagggaattatcttttttttcccactcactctgatggtgtgtaattgagtgtgtgggcacaaatacacaacagagggactattatgagtgtgctatgagtgctcatgtgtgagtgatgtgggtggctctgaaataccatctgagggtgctggtatgaatgatggcctgatagacatatgtgtcatcaggagtgtgataaaggagatgagatgggagcatggagaaaaggagatggaagggagatggatgctgtgaaaagggtgctggcagggctggaatccctgaggaggatcttcctccagctctgcccagcctccatttggtggtcagtaggggtgggcataagaccctaacctgttccccattcttcccacagggtgtggttcacacagttgggggctacatgctctatgtagccacaaccttcaagtatgtgtttgacttccatgcagaggatgtgttctggtgcacggcagacattggttggatcactggtcattcctacgtcacctatgggccactggccaatggtgccaccagtgttttggtgagaagggagccacctggcctagctgggggatggacaagattatcctgggtgactacctcccaaggctgcttggtctagagggagggggacttatacaatcatctgttttctggagaaagagaagtcctgagggggttgcgtatcctgactaggatggtatcttggcttgtctggccagggagtgaagatatggttggtcagaaagggcaaaatactgaacctgagggaatggtagggggatgaatagaaggactattaggaaagactgggaatgaccagccttcatgggtcagtttgaggggattcccacatatccggacgtgaaccgcctgtggagcattgtggacaaatacaaggtgaccaagttctacacagcacccacagccatccgtctgctcatgaagtttggagatgagcctgtcaccaagtgagacctcttcccagttgctgccctgtgggtatccctcagagctgggtgctggcctttgtacagtctcttcttttccattgtcccaactctctgacctggaatagaggatggggcaagagaaaagcctgggtatgtgtgtcttccagtagtactcagagccttcctctctcccattcccctgccccaggcatagccgggcatccttgcaggtgttaggcacagtgggtgaacccatcaaccctgaggcctggctatggtaccaccgggtggtaggtgcccagcgctgccccatcgtggacaccttctggcaaacagagacagtgagtgaagggtacagaaggctggggcccagggacaatgtgggaagattgactcaaatttctcatctctgacttccccagggtggccacatgttgactccccttcctggtgccacacccatgaaacccggttctgctgtgagtgatgcttccctggctggtcttgggctaggcagggatggtgtcttggggcacttggcctagttagatagtggagaactggactgacatgtgtgaagaatttggggttctggggccccttgggagttgagtcagagttgcctcattcctcttcttgggttctgtctcccgtttgcttctagactttcccattctttggtgtagctcctgcaatcctgaatgagtccggggaagagttggaaggtgaagctgaaggttatctggtgaggccctggcccttgggagtctttaaggagagagggaaagggtctgccaagggtactttgctttagagttaataacctaatctctcctggtagctgcttaggactgaaacttcatggttggaggtttgctcactgagagaccctggaggggaccctcgatactttgcctgcatctcttccttttgggccataagtctcctaagggcgttttaagagttgctcagattcctgatggtacctttttgggtctggaagactaagtcccatcttcttttgacaaagattctacagaaaggaggctttataacatagtagaaaatcacgtaggatctggagtcaccctgcctgggttcgaatcctagctctgcctcttctgtgacctcagataagttatttaacacctctgaatctacattttctaatttgtaaaatagggttaaagtggtgtctctggccgggcacggtggctcacacctgtaatcctagcactttgggaggctgaggtgggcggatcacctgaggccaggagtgcaagaccagcctggccaacatggtgaaaccccgtctttaccaaaaatacaaaaagtaactgggcgtggtggtggacgtctgtaatcccagctacacgggaggctgagacaggagaatcacttgaaccggggaggtggaggttgtattgagccgaaattgtgccattgcacttcatcctgggcaacaagagcaaaattccgtctcagaaaaaaataatgcctttgtctcctatggttgcttgcttgattgagttagataatccacatgaaggggttagcagagaaactaacaattagtacttgataaacattagctgttgtgattattgtattcatacttgcaggagcctcacctgtcccttcaaccccaccccatttcactttcccaagagcaagttagtaacagggacagggcttacatccaggccttctgactcagcctagaattccatccattccatcgatctgctgccaaagaatgttactgattgggcaataattatttacttggtgtgtgggcaccactgttttttaaatgagtgttttcatttgtatcaaactggacctgctttcctcaaggattgcccaaaaggagacacaaatttactaaacacttatcaataatagaacaccgtgctaggcaatttccatatactattaatttaatcctcacaataactttggaagacagaaagtattttctctgatttacagatgaggatcctgaagctcagaggggtaaagttacttctctgaggtcacctagctagtaagtggtagagctgggattccaagccaggatcctctgtctccaaagcctgtacttcattcaggacactttcccccacatttagaaaagctgtaattatcttccagtgagacagcatagcaaatgtgatcactgtcccttcctcactccccaggtgttcaagcagccctggccagggatcatgcgcacagtctatgggaaccacgaacgctttgagacaacctactttaagaagtttcctggatactatgttacaggagatggtgagccttagctatccccctcttgcacctcccactaagacatgtaccttccacttccattttcaggaagagttggtgtgttgctataaaataatacctgagactgggtgatttataaagaaaagaggtttattttggatcatcattcttcaggctgtgcaggaagcatggtgctggcatctgcctatggtgaggcctcaggtagcttccaatcacggcagaaagcaaagggaaagccagtgtttgacatggcaagagaggaagcaagggagagagggaggagataccagcctcttttaaacaaccagatcttacatgaactcatagagttactgcaagtacagcaccaagccattcatgagggatctgtcccccccgccccccccacctccccggccttgaccaaaacacctcccaccaggccccacctctaacactggggatcatatttcaacatgagatttggaagggacaaacatccaaactatatcagttggttaggggtaaagaaaattagagaagaatgtgtcctacatgtcagtatctggtttctacgcagagctacaaagactgtaagggcaggaatgagtatagcaggaggggtctcagaatggtgccatccgaactttgatgtatgaggaaagatggacaatgtatgctcctgtgttgaaagagatggggcatgtggcagtgcatgactattatgtcatgtttgtctttatgtctggagtctgtgtttctccatctatccatctaccaatccattcatccataagatctgagcactgtgatcctgtgcccaggcactgatcatgaataatgtagtcaaaatctcctccctcatggggattctagtaaggggagacagacaaacccaacaaacataaataagcttatcttagatagagataaatgctgttaagaaaaataaacagggtagcatgatagtgtgtgcagggatggctactgtacacaggatcgtcggagaagacttctctgaattgacatttgagcagaggcctgaagggtgagaaggaaacaggcatgggaaaatctagagtaagagtgttttgtgcagagggacacagcttgagatgtctgaagaatggactgaagcctgtgtggctggagcgtagcaagcaaagggaagaatattacatgacgttggagacgtacataatacagggagggtcttgtgggccatggtgaggagtttgaattttattcaaagtacagtgggaaaccttttttttgttgttgttgttgttgttgtttgttttttttttgagacagaatctcactctgtcacccaggctggagtgcggtggcacgacctcagctcactgcaacctccacctcccgggttcaagcaattctcctgcctcagcttctcaagtagctgggattacaggcgggtgccaccatgcctggctaatttttgtatttttagtagagacggggtttcaccatgttggccatgttggtctcgaactcctgatccacccaccttggcctcccaaagtgctgggattacaggcatgagccaccatgcctggccaccttttggggttttaagcaggggagtgctaagaattgatttactgtttagaaaataactttgctggatttatggagaatagagtttaggtgagtatactattggcatggaacaaattatcccaaaagttggcagcttaaaataacaaatattatctcacacagtttctgaggatcaggagtctgtgaacagtttcactgggtagttctcattctgggtctcttgtgagtttcagtcaagctgttggtagggcctgtagtcatctgaaggtttgagtgagcctggaggacctacgttcatgcttactcgcatggttgttagcaggaatcctcagttcctcacctcaccataggactactcaatacatggcagctagcttaccctacagcaaatgatctgagacaatgcaaccgagacaagctaggtgtcttctacaacctaatctcagaagtgacatcctatcacttctgccaaatcctatgatgacacagactaaccctagtacaatgagaaagaggactgcagggctatgaataccaagaggcagagatcagtggtgccctcttggaggctggctactacagtgggcaagagtggaagcaggaagacttgttagaaggctattgcagaaggtgtagcagtttggtaatgtggatcaggtatcctaccgtagggtttttatttattaggttttgcatttcttcccaggctgccagcgggaccaggatggctattactggatcactggcaggattgatgacatgctcaatgtatctggtgagggccaggggccaccttcccatcttattaactctgctcctctgacaacacccagccgaagccttccgcaagagcccaggagtgtcctttggccagaccatgtactaagtgtagcattcagttctgggcccaggttttagaggagtaatgaacactggaatgtgcctagagtaggggaacttggatggtggggtgactgaaagcatgtcatctgaggagtgaatgaagggtcttctccatttggccagaccaggactgccccatgggtacagatggagcatgggctggggcagagcctgggatctctctcatggcacttcctttcccttgacaaggacacctgctgagtacagcagaggtggagtcagcacttgtggaacatgaggctgttgcagaggcagctgtggtgggccaccctcatcctgtgaagggtgaatgcctctactgctttgtcaccttgtgtgatggccacaccttcagccccaagctcaccgaggagctcaagaagcagagtaaggagcctccctgggcagggactatagggtctgtcttggaggcccagttatcactgcaagttgttggggaggggctagagcaagctgctccccaaaccacaaacagattccagggggccccatgggctgattgccctcttcctgttcagtctccactagtctcccactaggataataataatagccaacatttctagaatactttgtgccaccgctaggctaagtgctttaaatgaattaccccacttaatccctagagtcacctccatgaaacagatcttattgttaccttcatgctaaagatgatgaaactgagactcatggaagttaaatcacttgcccaaggccacactgctagaaaggtggcatttaaactctagcaggctcattctacagcctgagttccataagataaaatgagagagtaaagagacaagtgtgttgagagcaagagaagcagtgaacctgaggctgtctctgtgggcagggacttgaggaggaaacaggtggggaacaaagccatctctactttgatttttgaaaagtctggctaagggtgctgaagaaatgcttgatgatttgttggttacagttagagaaaagattggccccattgccacaccagactacatccagaatgcacctggcttgcctaaaacccgctcaggtatgttcagaggcctccatggattgggatgggctgaggcctggtggtggtggggtgtgcgtggatgaaagcctttggcagggctagggtgggtcagtgctttcaccaagtaactagaggtctgtggttccccagggaaaatcatgaggcgagtgcttcggaagattgctcagaatgaccatgacctcggggacatgtctactgtggctgacccatctgtcatcagtcacctcttcagccaccgctgcctgaccatccagtgaacatgatcctgacctttacctaggattcctcctgctccaaactttgcccatcctctttgccccctcaggagtgctgagggccagtgttgacccacactaccctcccttgaccagctgtctgggaccggaaaccagctttgtctccaggtagagacaacatcctgtgactgccaggcagaaaggacagggcccaggtcagcctcagtctgctgtgcctccagactgcagagctctcagaacccagaacagagacgaaaaggctacctctcctacccaagttaagtgttcaaaggggatgtgagggcctccactgaagcagggaggcagctgtgtaatcctatgtcagctctcttaggaagccccagtacttatattgggcatgcacttgcccttaaaaacaatgatttgtgagtccaggaacaatttactatttttaaaatattttgctgcttctgttctgggtctgaattcccttttgtgccagatgccagtactgtctgcccattggctccaggggctgtatgggcagattcagtctccagagggtattcagatcatctgcttctttgaaggagtaaatgtgttttgttcctagggccagaggagcttgtcttccttgtcctctgttcccaccctcccctgaacagaacccagcccataagagacattctcagatgaaactctgttttcttgccccagtcaggctcaagccctgtggttgtaggaataaagcctgtgatctcaagaagtggtgacttgttttcttaggtatctgtgccctgaggctgtatattcattagtggctctgatttgtgtggcagatgggaagggaggggtatttcctaggactatccccaatatcttccttctagaacttttggtttgggcagagcgaaggaggcttcactgacagggcctttgacaagcccctgagctaagcaggaaagtgactgaagccagttcacaactgttatgtatgtcccatcttggttgccttccctcctgggctcctgccagggactctcattcctccctgtgatccagtaagagcattagtgggtggctaaggattgaaacttcagggttccacctgtagagactggtctagggggaccctgattacagaccagtcacttccctgctctaatacatcttaagtgggctaacgtagattacagctcccgcctcccctctatgcacgaagtaaggaatcatcactgaatcagcaatgcagttttatttaaggcagaattagggaaaggctatgcccctccactccccctcctcctaccactcagtcctatcccaagtcaggcactggaacctgctgaaaaggctgatgaggggctgacaggagtggggcagggttcatggacctttacctcagagcagcttaccctgagctatacccacatctcaaggatttgggggcgtctagatctcatctaagggagacacaacttttctggtcctcagatggaaagctgggggaaggtaccagtatttacccttccataaaaactttggaggtctttaggaggatacccctcaggagggctaggagaggaatgacaaatacagaggatagaaggtcccgtggcctggttgtgccctcacacagggtatgggttgtccaggactgccactcccgctgccacaccaccatctgcatgctcgatggctttggttcgaagtagatgccccacgtgcttgttcatcacgagtgtcttttcctgcctatagaaatggaggcaggggacacacatcacctggactcagccccaaacccaggaccttccctggacccagctgagcagtacctgggtaactgtctataccaagaaagtgctaggattttagagtctctatgcctctctggagtctccttctagtcctaggttgtcaaaccatgtgttctgagtcctcttggtgctatttggagtttccttcacggttgcaaaggacttctcatcagggcttcatctgataccctggtaaggtgggcaggtcttgggtccttggcctcatttaatagataaagaaacaggtaataaagctagtgattggcagagctggcaccgaagcccaggattcctgactctttccagtgttcccctctaggctggctcacttggctggcactcttgcaagcaggtagtggaaagagcttctcctgattggctcacctgacatagaccccaaagatgcccagctctgaaatgcactggaccactcgggcagggctgccaggccgtagcaggcaattctcaaaaggctcaggttcgatcttctccatgaggatgtaggaggccctctcctcactgtccttcagctgtttcagggcctgtaccatttcctccccatataggttgttacctgcaatgaaactggccagtcaccctggaccctctgcctacctcctccatcccatgccctcacttttggggccacatgggcaagtcagcagcctcagttcctggcacccgctcagtgaagccagggcatatctggcttctcaggagggaagctcactttgacaggagagcccttactcatgcagtgaacacatcttccactacactgttctgccctggttctcctcctacctacagctgttccttctcaagctccattgctggctccttctcttaaatgctggggtcccaggggaattggtcctccacgcttgctctctcccccatgtacattttcccaaggagatctctcctattcctgagtctccatctataccctaaaaattgttaacttccggccgggcatggtggctcacgcctgtaatcccagcactttgggaggccgaggcaggcagatcatgaggtcaagagattgagaccatcctggccaatatgatgaaaccccatctctactaaaaatacaaaaattagctgggtgtggtggcgcacacctgtagtcccagctactcaggaggctgaggcaggagaatcgcttgaacctgggaggcagtggttgcagtgagccaagatcatgccactgcactccagcctggtgacagagcgagaatccgtctcaaaaaaaaaaaaaaaattgttaacttccaaatatttaatgcaggctccctgcttagacatcatatgactggcccccaaacaaactcaacttgtccaagcagaacttattacttctgcctgaacctgcccctcctggaccttcctactcccaatcaggcaaaaggtacccctgagtcatatttaactcctcccttccactaccctctcactatctaggacatgtctctccagttggccccatagtcatagccctagcccaggcctctacgttgctcttctgaacaactgtatcagcctcttccacggtctttctgcttccagtgtctcccctcattccaggacatcttctacaatgcagaaactgtaagttttgcaagttcccaccactgctaaccacttgagtcctggatcaatgtgtcccttcctggcttaaaactccctaatggcttcccactgcccttaagataaaatccaatttctcagtatatattcaaggccctttataatcaggatgcaaaccatttttccagcctaaatccctgtcccctcccagctccccctccagcctcaccagtttctcattaacctccaaacatctcacactttcatggcccggtgccttggcttgaggttgtcccttttgtatggaacactcttcctcctttccacctgggaaattcctacccacctcttaagacaaagattaaaaaaatcctctcctctggagaggcagacatgacccctgacctcaaggagtttcaaactagaaaggaaaacagacatgtattctctccagtctcctaatatgaccctactctacttcccaacaatctacccacaggcacctcaggtaaaacttgtccaaacccttcaatgctggttaatcagattcccctgtgctcccggacttggtcacagggtcttaggggacactgtccaacatgtggcctgtgtcagttccaatagtttcccccatgcccgggactgtgcccagagtaagtgccaatgagcactggccacagcctgctagtccctctcattgaggagccctgcaaagggagatccacctacctccaccctctctctggggctttagcacaaaccggctaggggcagcaagggcctcggcgatggcctggtccccttcttcaccctggcaggaggcagaaagcagttatcaaaagtttaaaggctaaagaggcaagaagcttaggtccagctggttatgcagagcagcatcagaggaagagcaggagggagaacagccacaaattccttcaggcaggatgctactatctggatgacactcccaacaaaccccctgcagcagccgatgcaatgagaacaggcctttctttagcaacagctcagggctctgcagcaggcagcctgatacacttctcaattcttgccacctgccttagtcccttccctctggttgccatcctcatctctacctttgctgagggagcttacaatggattccagcccccatccttccattatgaggctgcccttctgctcagagttctaggggttctccagagcatcaccaaccttgccagctccaccttccccttgtcacaatgccagctccaccctccccaacacattgggctgtaggtctctgccacctaggaggcctgtggtaggagaaacaggctgcccacgtaccacatccagtgagtagaggccagcaaaggtggcgcggaggcgggccacagcctcaggctggccagggagcaacatctccagcatgcccggcctgcttagctcctgctgcaccttcttagtcccagccagctgggtggcaatgtctgggcacttggcagcatgtgacctctccagcagtagacgtgcttcccaattctgcagagggaagaagacaaaaggaattcgactttattttacttcagctgacgtttactgaacatccatccattaggtgccaggtatcatgatttgtatcttcaccctcattatcacccaggatcattctaacatccttgtgagccaggtgtgatatgttgtagttatgtatcattgtgccagactgtgagcccctgcaaaggcaagaatcccccaatctgtgggaaacaatagaaggtgtaagggtagaacatttgtctacgtgctcagcttcccactgtgttccatactccctaccatggccttcaagatccttcaggagctggctcctgtctactttttcaaccttgtaccatccctgactcctagtctctgccattctactcacacaggcctgtcattcctcaaatcacaaagctctttccctcctcagggcctgcactgcttttccctcaacctgaaacccccttcctttcggcttttcccatgcatagctggatccttaccatccttacatctcagctcaatgtcaccttttcagagaaggcttccctgtccactctatttaatgtggatttcccataattctctttttacccagttgtttcattgaaagcagttacctgagactaaaacacacacatgcacacatacacgcacacgcacacaaacatacacacacaaatcccaatttttttttcctatttttgtttactttttttttcttttgagacgtgggtcttgctctgtcacccagactggagtgcaacagcgcaatcttggctcactgcaacttctacctcctgggctcaagtgatcctccctcctcagcctcccaagtagctgggactacaggtgcacgccaccacacccagctaatttttgtattatttgtagagatggggttttgccatgttgcccaggctggtcttgaactcctgagctcatgcaatccacctacctaggcctcccaaagtgctgggattacaggtacgagccacagtaaatggccatatttttgtttactttctgatgcccatttctctgaccagactgtgagctccatagcacagggctcttatcattttcctcattttctgttgtatctccagtgtctaacacagttcctggcactttgtagttgctcaataaatatttgttgttgttgctgaataagttgaaatttgagtggggttctgaaggacaggtagagcctgacaagtgagactcaatagggaagggatactcaggctaagagaataatatgaacacaggtctcaagtggatgatcacaggatgaatggtttattaccacaagagctgagggtataaaaggcaaggaaacagcaggggatcatgcctcccaactctggttcccattctcatgcaatggggagacagtctgtccttggctccagaccactgcaaactgcacacagcaggatcaggtctctcctgtgacccccacccaatgctgtccttcctttgatactactggtccacctgtagcaccttgacctgatcttcatcaataaccccaggaacccaactactagtctggcattccacgcagaatcacacgtgaccagaacatcagaaataaacccagagaaataccccattatggtagaagcaggaaagcaaaaccaaagataagcaaggacttgcccagggtcatctagtaagtcactaagccttctagatctctctccatgtctaaacctgctctgagctgctcagttccctaaaaatgtctacctcttggccaggtgtggtggctaacacctgtaatcccagcactttgggaggccaaggtgggtggatcgtaaggtcaggagttcgagaccagcctggccaacatggtgaaaccctgtctctattaaaaatacaaaaattagctgggtgtggtggtgggtgcctgtaatcccagctactcaggaggccgaggcaggagaatcgcttgaaactggaagtcaaaggttgcagtgagccgagatcgcaccactgtactccagcctggtcaacaagagcaaaactctgtctcaaaaaaaaaaaaaagtctacctctttaaacactactttccttccttgttatctcaaactcttctaagttttctttgtcgtgttttgaaatctagacccatttcttttttttttttttgagacagagtctcgctctgtcagccaggctggagtgcagtggcatgatctcaacttactgcaacctctgcctcccgggctcaagcaattctcctgcctcagcgtcctgagtagctgggattacaggggtatgccaccacgcccggctaatttttgtatttttagtagagacggggtttcaccatgttggccaggctggtcttgaactcctgacctcaggtaatccacctgccttggcctcccaaagtgctgggattataggcgtgaaccaccgtgcccggcctagacctatttttctaatagacagtttatctctcctgtagtcagcaagttgccaccactgctaaccacctatctaaagaaaaggatgttctatcgagataccacctctatagagcctcctcatgtggagctcaaccctcggggggagtcctagatgaattacagacctagaaggagccccctcagttttctagtgtagctccccccgctcatagaaacagacctagaaagggtcaggaacttgcccatcatcacacagaggcagtcaagctcatgacctccagctcactgcccatggtatttctaaacttatttcctcctttatcatctcccagctgagagcagagcttcttagcctctccatgatgtggatgttaggagcagaggagaagaatgggaataccatcggcctgaaagtcagaaaacctgggaacttcctgtagggccttagagaagcctctccatctctctaaacgttagtttctccatctgtataatggggataattatatgcctcaccgagtggttgtgagggttaaatgaaataatggatgtggaaactaatgaaactacatggtaggatagcaaaatgaggtgatataactgtcattaacatgaatgaggagatgataaaactttctgattcagataaaggaaaggtaagagttggcaggaaaaaaaatggtcagcagtatgctggaactggcttatatcaaccagtgagagctgattgttgttaaacatttgccagcacatctctggaaacagtgtaaatggctgaagctctgtggattcctgaggattcaaattctagaagactgtgtagagtgataggtagcaaaaggcttgagggaggataggaggttctagcagcaagctccctgagaaagaagtgaagtgaggactcggaaaacccaggttgttataagcctgaattgggtctctgtggagctcttgtgggtcccaggaggcaaagaatggtctcacagaaaataccaacctgtagactgtactgacgaggcatgtagccatcccggaagtaaaccacagcaatttcctggccatccctggaacacaggatggagaaggctgctgtgttaaattataactgatttgttcagtggttcaatctatttcagggtgcatcaagatgaatttggctttttcaaaattcagcccacagtgggagcctggtcaggggttcactggaaccagtgaaagtagatatccacactaccagggcttccactgaaaacagggaggtgtgccatacagaatactttagaatatgccagatttagagtcattctaagaaggccagaaggaacaagaaggtcactagaatcaaatttggtaaatgcatacaaatgttggctcgaaattaccgagcagcagaatcatactgccatgtgtagtaaaacacactttatatttccactgcttaaagcagctgaaaccagaatgaaaaaatttttaatggcaggggtgaaggtgaaaacgcaaacatgtaaaatgatgagtctgattaagacacaggctttttaaatgtcttttccttttctttgacctatttgatattgtctagtttatctgaaaagtaaattaactactttgtttagttatgataaaagcacattttgaaaaacagtgagtggtattgtgaaattccatggacagttttaattttaacaatcacaaaggtctaggtctaaatatatgtgctgcaatgctacccaaatatgtagcaccaaatctacctggtggtggcccctagagaaaaggataaggcttggcttggaacacaaatccaggctcgagctcagacagtggcatccagaccaatcacagcatgagccagctgctcctcttcctccctgactgcccagctcagcttctcaggcctgacctcaccttactaggagaggcaagaaaacttttgggaacttagggcatatgaaaactaagatgatctctaaggagaccctgatccagaatgtcaacagctctgatagaagcacagcgtggctggctttctccaaaatttcctgggaggatgagatatttcaggaattatgagagaaggaagcaagccatcacatctcccagaagaaagaatcattttggggaagagggtggcaggatgagtttcataaaccagccttccactggattcttgggaatgcttacacaaacagccttcggtcttggtccagagaccccttttcagagatatcttcaaatgttcgtcggatcacatggatgttcctgggaaaaatgggcaagagccagagggaatggatgctatgttctgagtgccccacccctaatcctggagccacacctagaagtcccccttcctttacttacctggccagtagctcattctctatggcacgctggtcaaatatgtttctttccttctcttgagcaatcagtagcaccagagcactggggaaagagcacaggtggcccgaggctactatagaacttgttcttcttttgtttctcccctcaacccccataccgccccacctcctggaataagaataagaacaccgcttccctgaaagaacagatgttccctctctcaggaaccttgagattacctcaggcatagacacctgatgctatcacatatgatttcctgaaaatagaaaacttcaaaaatgaagatgcctctgacccttctccagtgggcagatgaaatattgtaatgatgtcatgggttgatgaatttctgtgcaaattaaaatttagatttaaaaccatctcaaaaacccaagaggactttttcttagaacttaacataattctaaaatctttctggaagaataaacaagtgggagtattgaggaacattttgtaaaagaacaatgcagggggtccggggctaatggctctattactagattgtaaaggatacaataaaggaatgtggttcttacacaagatggaaccctacagaaacccacagggccaactacaaacaacgacattatctcctgggccctcccaagattcctataatgtacacagggccacatttgatctcatagtattaatgagatcactagggcttatgtggcttcttcctctctgattattcatgtatttcttaaagaggcaggggcttgagggctcagggaaaagcttatgccagggaactatctgtttggctgccagctaacatatttccgttgtcaaagataggtccagtcccctaagagattcctagggctaatgctcagcagtaccaaactgcattttttttcttttacattttattttatttatttttttgagacggagtctccccctgttgcccaggctggagtgcagtggcacaatctaggctcactgcaacctccaccccctgggttccag

SEQ ID NO: 489 - DNA, 375019 bp, Homo sapiens
attttgagatgctgcaaagctcactggatttagagtcaagagatgtgggctctagcgccagatttactacagacaggctgcctgaccttgggcaagtcacttatactttcttggcttcaccataatgggctgaactgaatgttctctaaggtgcctctcagccctaacataatatgattcttttcatgagaagagcaggacttgatccccccatcacttgggggcatccccaaggagccccctgttcttcctctgcaggcagccaaggctaattaggaatctgagagaatgagccaggaaaggggcagtacaggacatacattctcttcattgaaggtggtaccccctccccactgcacgatcctcaggaagaattcctttattgaaaccattattgaatagggtagatttaggcacgggaaatgtaaacagcaaaccagccactaaaagtgcgttaatgtcacgcctgtaatcccagcactttgggaagctgaggtgggcggatcatgagatcaagagatcgagaccatcctggccaacgtggttaaaccccaactccactgaaaataaaaaaaattagctgagcgtggtggtgtgtgcctgtagtcccagctactcgggaggctgaggcaggagaatcatttgaacccgggaggcggaggttgcagtgggccgaggttgtgccactgcactccagcctggccacagagtgagactctgtctcaaaaaaaaaaaaaaaaaaaaagaaagtgccttaatgttctgagcaaggataatgggctagagcgtgttccggaagcctcagcacactgcttgttctcactgataggacctcgttcacgagatggaattatgtaaaatgccgcagcaatggttaagtgttggaacaaagtaatacagctttacattaacatggtttattcactagaattaatgacctagagcagtaattgcattttcaaaacttcagcttgctgactaggtgtattgctatgtaaatagctagcgatatttgaagataggaacacagtaaaatctgtaaagtaataggattgtagaaatatggagctggaggagaatgtagtcatcttctagccccgaggctggcaaactttaaaaggtcaggtaataaatattgtaggctccatggccatatgttctctgtcgcagctactcggccgttatggtgcaaaagcagccatagacaaaacgtgaatgaatgggcatggctgggtttcaatgaaagtttatttaggggcgctgcaagttgaatttcatgcagtgttcacatattatactccttttgatttttaaaaatcattttaaaatgtaaaaatcactctcaattggcagatcatacagaaacaggcagtggcctgtagtctgaagtttgccgacctcacttctagttttctcctctcatttcacatgtgaggaaactgagattcaaagtgatcacaggatttacttaagttctcatgactgacgccagagtattttaggagcagactaggagagttttcatgtagacagttggttgttttgatgatgaaaattgaagccacacaaaaattattctccagaagaactcatttcgtatgtgtgattaatactgtgaattagaatgtaccagtggttctcatgcttaagaattcatcagagtcatccaggggccttattaaaacacatgctgctgggccccaccctcagagttgatggttcaggtctggagatcttattttctccattttacaaatggagaacctgaggttgagagagatactcagtctcaggcttaaggtaaaatagctagcttgtgatgtcccccatttccaagttcagcactcataggattaggattagagctataagtaatcatcaagcagagaggcagggctgcagttttgtttagagagatccttctagtctagctgttgcggggagtatggattccagggggccgtgtggaagcacacaactctatgagaaggctgtgcaggaacctggatgtgaagtgctggcagctggacttcaagagtgaaggtcatggaatggatgggtggatggatgagtgggatggatggatgggtgggatggatggatggataggtgggatggatgggtgggtgggatggatggatgggtggatggatggatggataggtgggatggatgggtgggtgggatgggtggatgggtggatgggtgggatggatgaatgggggatggatggatggatggatggatggatggatgggtgggatggatggatggataggtgggatgggtgggatggatggatggatgggtggatggatggatggataggtgggatggatgggtgggtgggatggatgggtggatgggtgggatggatggatggatgggtggtatggatggatgggtgtgatggatggatggatgggtgggatggatggatggatgggtgggatggatggatgggtgggatggatggatggatggatgggtgggatggatgaatgggggatggatggatgggggatggatggatggatgggtgggatggatggatgggtgggatggatggatggatggatgggtgggatggatggatggatggatggatgggtggggtggatggatgggtggatggatggatgggtgggatggatggatgggtgggtgggatgggatgggatgggagaggttcagaaggcctagagggctcatctgtggaaccaggagactgagctgtggggatggtgactaggggtggtcccacccactgagagggtcacagagagaggagcattagaaggtgactccagtgtgtcaggtggtgagtttgaggtgggcttggaaatgcaagagagaggcccgaggctgagatcaagtgctcaggatccttggcctctccacttggagtcatgagtgtagattttaaaaatcatgcaggcggaacatttccagtcaggagagcactgagcccagccctgggtcacaccagcatttgaaggtctgatggaggaggaagagggaccaaaggggagtgagagacctgtacagagtctaagaaggagagtgatgagtcgcactgtgggccttgctctgtggccttggtggcttaggtaatcctggctctgccttaccttgtgtgcgcttgggcaaatgatcgcttctctgcaccttgcttctctcatgcataaaatgcagatgataaagtaacgtgtagtattgttatgaggattaaattagggaatgtaaaatgcttacaatgttgggcatttagtaaatgctcagtaaacattagaggaggccactgggaggagtagaaaagtgagtgcatattttacagttcatgtatttgcacctttgaaatccatatgttgtttgaaaaatgttcttcatttccatgaggaagacgccgctcccagggaaatagtgagtctaagcactttgagaacacttatctaagaggaaggacaatcttagctgtagtcagagtgaccacagggaggaggctctggtctgaaaacatttcagaacaaaggattttaccactaccaccaaaaccaaacccaaaacaaaaccccaaaacaacaactaaaaccttccactgtagtccgtaggtagctcccagggggaattgtccagtgaagcaaaaaactctcattgaaaaacatacacgcataaggatataggccccctctggggaaggaaggggctggcctggagaagaaatccattggtagtggccctgtggagctggtgctaggttcacaagtgttcatttggttattatacctcatgacttatgtatacattgcatatattttgtatgtatcacatacaacataaaaaaatttaaatctatgtattcacttgctttcacagtattcatagcaaatgagtgtctgaagcataggaccagagctggcagcttgcaccgcttctgttttgcataagatattttccccagcccactcagctctataaagttgttttgtatttcaccacttgctccatcttatcttgaagccttgcatatttttttaaatgctggttctgatcatgcttgcagggtgtggctcagaggatcgctgttggaccaatggagatctgcctgggcccagcactcttatgagtcccctgtgatttcatcagcatctgcctttagaaacccgggcgtgtttgttcccatggtaactgctgcccctgacacgcctgaaattcctgggatgcccttgcgtggaaggggagcccgtgctgcccattctacccctgcatggggcagctgcttttctccctcagggtccccagtcctacccaggcaggggtggcagttgttcatctgcagatcctgaaggacatggaccctgtgcctgagattaggacggccgcaccagcctgggtgcaggctccctcaagtgtccttcctcatggacccgcggaccctacgctgtgctgtgagggccggggagcacaggggcttcctgggaggaggactggcttcctgcccctgatggggcctggccacagctcccagggctccatgacagcacagtgaagatagcaaccacatcctgggggccctggatgcaatccctgcctgttgcaaagatgagataaaggcgcgggaaagaagggtctgaattaggggttgagctctgaaatcggacgattctgtgtttcctgccgcatggagggcgtgtgtggttcgcaggctgtggggggcttcttgcagcgggggctgctgcctaaacagactccgcgggccccatgatggcaaaccccctcgccccgttcatgacttaatgcctcctagaagaaaaggctaaaaacaagacacacagaacaagaaattgcactctctcaaaacgacagtcgccctgaaacggacgctggaagaggtttccaggcccgtggcgacggtgaggggggtgaaggtcgcaggtggagggcacggggcggcggctgcggagcccggggaggaggcggcgggcgcccgggtcttcctcggagcgcgccccctgggctgggcggcgtgtccctgcctcccgccggcgccctcgtccccgcagcagcgtccccgccgccaccccgctgcctcgtcgcctttctcgcaaacagcggtgccctctacgtgggggatcctggaggctgctgagcacgagcgccctccgcgacccgcccctgctcccgcctccactcttgcctcggggggagggtctcagtcttctgcctaaggcgccctcctcccttgggaagtccgccgtcctctgccgtgaagattgcccctctctcctccagtgcctcctccccagcggcttcggtggctcccaccctccgcaccccgtctcgcgacctccccgccagcccagcccctcaccagaagaggctttctcttccagcccctgaaatctggcttctgccccagccaggaggctccgcagggcgctccgccaccaggtggcatttcccacaaaccggccactccgccctgacccctctcctccctggacctccgtctcccagttttcctccctccaggatcccactctcagtgtcttgccggattccagtccactgccagccattgaaggcggaggttccttaacccctatcctggggcgagcccttccctctcactgcagaagagcttctcagctaggggggtcgtgcgggcccggagagctgcatttttaacaaactccccacactgacaatctttgccaacccttcccaggcaaatcttgcccccacgttcatggtctcgcctcccagcaggtttggcccacccagctagagctccagctcggcccttcctaagccccaagttgcatagctgcctggtgggtgcgtgttccacaggtacctcggactcgccctgaccccagaacgtctcttctacgccaggccgatccctcctgccatcctctgtctgttaaatggcactgccattgcctgcaggacgaagtccatatttgctggtttggctacagagtccagcgtcgccttcctctgagcagcctgcagcctctggtgcagccacactgcacagcttgcagtttccagacacgcattggcctttgcagtgcggccccgaagtgggaaggccccgcccctggccctggccagaaaagcacccactcatcctttcccatcccagcttgcccgctgagtgactttgaatcaatgattcatgttgtctgtgcctcagtttccttaaccttaaagtggcataataattagttcctgcctcatggaattgtgagtgctaaataaacagtaagtctagtgcccgacataaaagtgctcagcatacgacgatcatgagccatgtctaagcaggcgcaagccctcccaggcttctcatctgcaatattggccatttctcttcatgcctcagtgtcctgtttgagttgagcatgttttttttacaagtgagtctctcctccattggccgggaaccgcccgagagccgggagcatttgtcattcttgatggacccccaggtcttaaatcagtacttgacccttaagaggtgttggccgggcgcggtggctcacgcctgtaatcccagcactttgggaggccaaggcgggcagatcacgaggtcaggagttagagaccagcctggccaacatcgtgaaaccccatctctactaaaaatacaaaaattagacaggtgtggtggtgcgcgcctatagtcccagctacctgggaggctgaggcaggagaatttcttgaacccaggaggcagaggttgcagtgagccaagattatgccactgcactccagcctgggcaacagagcaagactccatctcaaaaaaaaaaaaagaagaagaagcagaagaagagaggtgtttagcaaggcttggttcgtttggtgaattaactcagtgagttaaccaccattaacgatggttaaggacacttgggcgctggctcgatttgactccgagctttaccgattacttgtgtgactttgtgcaagttaattaacatctcagcttgttttctcatctgtgaaatggggatgatactagcatgtacctcctaggactatagtgaacttttaattaagataattattgaatttaacaggtagtttattaatgaaatttacataggtaattgtggcgcagtgagcccaggggctcaaggtgttagcagtcatcaacagtgctatttgaaactgtgggtggatgaagaggtgaactcaacaccacaaatatgacagagcagtaaccaccatggaaaagaaaagagagcttatgtgtctaggacaccccaagaaatctcttctgaatgaatgatggcaatgaaatagccattaacagagggtaggctggtttgtgcagggttggaggcttttccaaaaataaataactttcaaaaaatctcagccaggcgcggtggctcatgcctgtaatcccagcactttgggaggctgaggtgggtgaatcatgaggtcaggagttcaagacaagcctggccaagatggtgaaaccctgtctctacgaaaaatataaaaattagctgggcacggtggcaggagcctataatcccagctacggcaggagaatcgcttgaacccaggaggcggaggttgcagtgagctgacatagcaccgctgcaccctagcctgggcaacaaagcaagacttcgtatcaagaaaaaaaaaaaaatcaatctcgggccgggcgtggtggctcacgcctgtaatcccagcactttgggaggctgaggcgagtggatcacttgaggtcaggagtttgagaccagcctgaccaacatggagaaaccccgtctctactaaaaatacaaaattagccgccgttgtggcacatgcctgtaattccagctactctactcgggaggctgagacaggagaattgtttgaacccggaggcggaggttgcggtgagccgagatcgcaccattgtactccagcctgggcaacaagagcaaaactctgcctccaaaaaaaaaaaaaaaaaaaaaaaaaaaatctcttttcccaatatttgtaatactgggagtgttcaagttgatttaaaaattgagtcaattggaatccatcctcagctcttagctgtgaagggagagctgccccttcttagggatctcacttctcacagcaggggtgcttctgtgtgtggacatcctggtcagctggtcccctgctgtcttgtggggctcacacccaggcacttgattcagcggggtctgggtggtgtctccttcctccttcccaccccagtaatcgctatagccttcccaggcccccaggttgcaaagcactctggactaaacctcctccaggttctgagggctccataggaggaaggtctaggccagaaccggccccatcgctgaaggtggagccagggtggccggccgtgaccggtgtttatgctgtgagagcggctttggccctgcccattgccctggatgggctgccatcccttttcaggagttcaaaaccacatactgagcccatcggtccaaaggaccatcatctcatttgatccaagcacagggcaagggaccacatggacaatggctgctcgtggcaccttcttgccatgcagccatgtcatggtgtcacttgtcacgtttcctggcaccttcttgccatgcagcaatgtcatgatgtcatttgtcacgtttctgttccattcttttcgagcaagcaggaagccacggggctacctcagttgctcttagccagtagctctctccacaggtaggccttcatcggaggggaaaagccaccttagggttccagagctcaagggcgaatgatgctttccacccactaatttaaatacggaagcatcagattgtctgcttctcaaggaaaagagctgttaccatctctgtctcttcaatgggacccactcctgggccccacagcagggcaggtgctcagatgaatggtggccgcctgcctgtgtcagagggtcggcctaggcaggttccccagtccgctggcccgggacgtcctcctctctcccggccgctcactgttcaggacagcccgggcccccccctggggccttgcaggagagcttctgtgatccactgggtggctttgagggtagctcccaggaaaggctgcctcagccccagcgtgatggggacgggtaggggccgatgaggcttcccagagcagcgatggccttaggtattgccagaaggaaacctacttttcctccaagatcagagggaaggatgaggtggggtgttggagcatcaccatatatatacatcacacacacagggaaacactcctacttggatggaggatctttgctgttctgttgaggccagcctgatcctggaggcagggcagggcctggctgttgcccaggctccaaagaggcgccagggcgtcccttagtccttacactttctccagaacctgcgggcagcaggaggcccttgtcgggacaggcaaggggggcggtggtgcggaattgtgggcgtggcagtcggaggtgccaagcccggggaggcggggcttcctgggagcatgcgtagtgccggctctgcctgggcggggtcctaggctgctgctcccgcctcccccggcacaggtagggcgccccgcagacccggacaacgctgggtgtggctgaaaacagggagtcatggtgcgttctggggaagggtcagggctgggggctcgggcccctggaccaaagactctagccaaatccatcggaggctgagcagggcgatggggcagggccgggggagccgtggggaaatgggagggtgtgggccgagcagcgccggaggcaggtaccgaccatcgccgggtttcccagagggcagtggtacctgtgcccacatgtgcggccttttttgtaaaggaacctatcccaacccgaaggcccaaacgtgtggccgtgtaagtttagttgtgcccggagtcccaggagagcccggactgagggcagccagaggccggtgtccgcagaacggcccacgaggccttcggctcagtagcctggagtttgaaatgcaccttgagctttaatggccttttccttgtgagaattcgagttaacgtgcctgctggtgcttttgatgggtgaggacggtgaggcaggccacacatctcgcttctttccagaacacttctgggtagtcgttcaattccacatttaatccaaagccaacagttccatgggtgactgtgctgctggctgtaggaagccgactgtggacagatgaggataatggtctgagtgaattagcaagtctggagaggagcgcccatcagcagaatgacaaatttaggatctttaaagacatctggtcagcgatgccggagctcgtgattgactgagtgattaataatggaaaacccttacttcagtgtttccacggccctcacccacttccccagccggggcggccgtctgctcagcctgccagagacctttccagctgaacaatggcggcatttaggcccctcatctttgacctctgcttgggagttcaaagcttccttttccttctacttaccccacttatctgcgtgttttctaattgatagtgtactgagatggctcccagttcccacgcacatttgctagaatgttaccttcacacagtgcgtaccaaggacctagtgccagccagagcctggcacctcagggtcaccctaggcgtcctgctcatggttccctatcaggggcttccctcagatacacacagcccctgggcctgttgaaaggctgacgttatccctctttaattctgcggtggatttttctccaggctaaggcagctggataagcacagccaggccacagcccagcagctggtgcagctcctcagcaagcagaaccagcttctcctggagaggcagagcctgtcggaagaggtggaccggctgcggacccaggtactgtgcagaacgcggcgcaggtgggagtccttgggcgggcgtctacaggtggatcttttatgcacctcaacaggccggctttctcacggatcacatcggttagcagtaagctgggagggaggtcccgaagactgtgctgggcacagtgcaggacccagagaagcggagccatgggcccgtcctggtgagggagttaaagtccgtgcaggtgaacagaccccggcccgcgaatcaacgaaccacaccgagtgccaagttgcgccgtgcaggctgcggagggtgcgagagcagggagaagcgggaggacggccgtgggcggcagaacaggctttttggaggatggtggccttgagctgcctctgaaggtcgtgtatggtttgaattggttgaggaaagaggtgttcccaattagcaaagtcgtcttgaatggaaggcaggcatctcatcctaaattagctgactgattactgggctaatatctggagtgcttgcagagcacccggcagtgttacacacagaacatgcattaattccctttacccttgaacaagcaggcgatgctgactttattgtcttcatggtttagatagggaaactaaggcccagacaagcattacagctggcaagtagggacaccgcaaacggaggctaagcctgactccacagcccaggctttccccattcaggttagatccggggccaccagcagggaaaagggaggaaggaaagtgtcccggtgaatttggaacacagtatgaaacctcgtttgctaaatcgcttctcttcctgtcagagaggctgtgcattttgccccgtcaagcagtttgttaggataatgaggtggtccgtgggctgaccaaggcctccgcctttaattaggattgcacccaggtgctctgtgagtgccctggggacttcaggcagtaagtgcttggaatgattaatatgaaaaatgcatctggaaatgaaaacgaagaggagtctcattctcctcacaaaatgaccctgtgctcaaggaacctgtaagtactgacttttcccactcggtccaaaatccctctgccaaacatgtgttcacagacagtaaatgagcacacccaggcgccacggagctaaggcctggaggtggaaatgcctctactgtccccatgcttctgagactgctcccagggactgtgggggagcgggccgctcaaagtccgagccacagccgcactgccacagctaatctaggaggcgaggcctcacctggcacgctccatggcagggccctggaacctgaattttgccaagctgttgggatgattctggacgacactacattttgaaaacctctgaagtgtttggagctggaaagaacagagaattattccaggttgtgtcactgtgctgaatcccctgcccccgcttcggacaagtaacttaagcctttttccagcctcagtttctcctctgcacagtgggcatggtgcacgcctggcttcacgggctactgggagtgctgagtgcaggcgggatgccccacgggcccttgggcacacaggctgaggacgtgtgagggtgtttcctttctccctcatcttcagagggtcctgggagaggttcagggaaggcagaggcctgcagagcagcagctgtgggaccagtgccactcccctcccctctgctttcaggatgaccccctcatcctccaccagacccagcccagaacccagccctgtgggcaggtccccagggagggccccagcagcacctgctttaggcctggccagccaaagatcaggaccactggagccactaggtctcctggcaggtgactaggctcttgtcacataggagggagggaccgtgactcctggcatgagtgaatcttcagcctctaaagccaagaactctgtcagacctcaggttgtggggagtcttccgtggaagctggagcacacggcagcttcctttgggctctggactagatcaggagaacgtgggctttgccttttaactccccatctgcctgctttacagcacacttagatcttaacatggatcaccgatgcttagaagcttcttccagggctttaaaaatctggctattgccaaatgagttgcaaaattttcacaaaacgcattaaaaaaaccccaaacctcaaaaaatcctcagaaaaactagcaggtctttctttcttcttttgcctgaagcaacagcaatgatttgcccattcctgtgctatctgatactggcccatctggctcatctctaaagcggcctttcagattcaaatattacacttggagttattttaatatgaacatgacaaaagaaatttggtagagggaatgttggctttcagttgcaaatactagtggtcagagaggaggcagggatccaggtttgcaagctctctgctgaatatctaaacccagagcctgctttttctggctaagcctggccttcacctctaggtaggggctgtcagtgggcttcagcctctgcgatgccttcttgtcatggaatcagcttgagttgtgagttaggcttctgctgagccatgatgtgggcgaggctgctgtaggttcgagcaggtattttggatgcggtgccgcctgagggctccggagtgctcagccaccctctctgttttcctggagtggcctgtgggtccagatcttgggcagctgagggttagagctgtcctcatgtccgggttagagatggtttaactaaaggcttccgttttctcagcctggatgagttaagcttaacttaattttgcatgtcaaactctaaacatctctgtccacttaatacccagaagagaatgggtcgggcaatggttccaaagcaaagtccacccctttccttccctccctgtcctgggtcctgagccccgctgcccctggtggtggggctcaggctggcctgtggcctccaacaggaagtgtctagcctgttggcaggcttcattattctaattgtttctgcttgaattctgaaacactcacaacaacatggctggcagagggagcccctggtagtggtagctgccacatggatgcttttggccacgagaacccccatcctccccgctccccggcgctgtctgcggtgggcaggactcagggcactggctcaagctctcggctcgtttcttggcttttttttttttttttttttttttgagacggagtcttgctccgtcacccggactggagtacagtggtgcaatctctgctcactgcaacctccgcctcccggcttcaagtgattctcctgcctcaggctcccaagtagctgggattacaggcacccaccaccacacctagctaatttttttgtatttttaatagaaacggggtttcgccatgttggccaggctggtcttgaactcctgacctcaaatgatccgcccaccttagcctcctaaagtgctgggattacaggcgtgagccactgcgcccagctgtttttttttttttttttttttttgatgagttttgttcttgtcgcccaggctggagtacaatggcatggtcttggcctactgcaacctctgcctcctgggttcaagcaattctcctgcctcagcctcccaagtagctgggattacaggtgcctgccaccacgcctggctaattttgtatttttagtagagactgggtttctccacgtaggccaggctggtctcgaactcctgacctcaggtgatctgcccaccttggcctcccaaagtgctggcattacaggcatgagctttgcccggcctcttggcttgttcttagtttagggtgactacaaataatggcattattgatctcctgcctcacctgggttcggaaacaacttcaagaaaatagcttttaaatgtcatgaaatggctcttacttgtccttgtggagaaacagacactgaagcactagcccagctttgcctagatgcagttccccacactctgtattccgggagggtcagggcctccagacacacaccctggcctgtcttttgtttgagactgggctgggtagtcgcactctcgccctcttgagaggcaggccctggctgggggaggctgaaaccttggtggtgggggtggggggagggggattcggggtgagggtggtgggtctcaggggagtttgggcagggcctgacagcttggagcagggtcaggggtctgcggcccagagcctgggggctctaacatctggctaggaaggttggagccagctggtgaggaaacatgagtcttggggagaatggcatctgggacaggggaaaacagaaattatctgtccacttagaggatggtctcaaccatcaagatgattttctgtgtctgctttcttatttggtaatgaatacggttttggctgacttgcattttctggtagccgtcgtatcctgagcaggctgcttggttctgtctgcagtgttcaatctggggagtgattcccttttagtcccctcatatgaatcacttacagtttagaaaacagagtcggaaactgacttgtcagtggttaatcagttggccctatgacttttaagcattcttggcagtgaatttactttctaatttgatttaaacttgtgcatggatccagcagccatatgtgattatattcaagatcatcgacattatctcattataccaaaggactcatagaagagagccgaaaacaagcaggggacacagagacacagaagatgatgaagggaggaaaggcccattgcaactggaagcaaagggagaagggaggttctagaaaagtgacagctctcagggagcaagactccctgccgagggaggcctggctgcaaggcggagctgctgcaggctgcccatgttaggccttggaggtgtcacctaatttactgtggtccttccaggagccctgggggcctcgcccagctgacttaggagctaccacaaagttagctacctgtaagacagatggcgcttgaatagaacagcaaatacattgaataaaataaattaaaaagcctcctcctgaaccaagattttttggaaagaattctaaatagatgaaaacaaacaatttgatttcaaccaaattgttgtttttttgtttttatcctgattttcacccgaattgtcagtctcaaaaataaacactgatacattcccagaaaatatttttcaaataaaaactgactctgttaaagtttgccctgattctttcaaaactgtgtacaagacactgtcaaccaaagtgacttgcatatttttttaaataaacttgaacatatgcagctaaaatgtcattaactccctgctgcctgagtgtttttaaaaaatgacacaagaccctgggtgctgcatgtctaacataagcatctcgcgaccttcggagaaacttccccaaacacctccaacagcagacagttaaactttttgttttttgactgagcgccccgtgtataattaatattgaaaagcgcatagggcttcattttagccagacttgctcttccgttaacagttcactttgtccaagagtgagtactttcagaataagaatcatgggagaaaagtcaattgaattttatattccttcagatacattcactctacttattgcttcctgagtcagacattacatttcacaatataaattcacaatcaagattttaaagggagctaaatattttaatccaattagacaagtgaacaaaacactgaatattgcatgtagtgtagataagtggttcttgcctttaaaagactgtaattccgtcacattacaaccccaaatgtcagtgttgtctttatttttaacactttcaaacatgaggcagccagaggctccactctctgctgttggtgacactgtctgtcctttgggaattcttaaaatctatttaccatggaaacatggttcatataaaacacagacctgcctgtgtgtagaggaagttctcatgactcaggggacttgagaaagctggaagatgacaaactcagaccccacggttgggaaggaacccttgggcttgggtgcgccctggggaggacaggtggcaccgcagagccagggcctccaccccggcctcatgtgtgctggggcctccctggcctgtgcggggccgcctccctctccccgccaagtccagctcgagatgctgtcttacggaacgtcccacttcatgtctgcaaggcggccttctctgtggatacctttccattcctctggtttctgcggccctgttcctttctcggagcccagaagcagcaaagccaagccctgcggtggaagggaaggagggctttgaactctgactgcggtgtggaggctgttatcaggggcccagccgggcagccaggagggaagaatggccgctgccctgcgatggccttaaccgtgagcccccgcctgctttgcagctggcagagccaggttcctggaaaggcctgacccggaggggacgaggcccctcagtgagaacttcagtcgctgtgctggggacagcagggccgcaggggcctgagggtggctgactgcccctcggctctgtagaggagtgctcccttctgacaggtgggcggtcctgctcgaaggccgcgtttccccgacgttctgcccagcatgctgagggcacctctctcctcagtgcgttggtggcgagccagagctcacgtggcttatttcatccaggttgccttcccaatttggcagcttaattccgtagatatcaaactggctgcccctcatctgccagagcaagcaggagagcctcgcatgggagagtctggactttgaggtcaaactgcctggattcgaatctcagctctgcgttgcttcagagacatgtgttagctttcatgtcacttgatttctggcagagaaaaagaaagaaccagcttccctttaaaaggaagtgcctcatattacccagagcccagcacagatgattatgaaaccaacaggattagtgctgagatcattgtgggcttgaaagggccatttgagataaataaccattttgtacagatagaaaaataaggcccagagaaatgaagtgaatggaattgggaagtggctgggcagggaaatgaacttcttctcaggccacaggatgtgtggatgggggcaggtacccgagcgggtgcgggcggagccgggcctggctggaacagctgccgagccctggccccggtgcccagaacacgaggcggaggcgggaggcgagccaccaagcgaggcaggggctgccctggagctctgtcaactcagggccagctttgaaatgccccagatggaggtagggggaggggcctgccctctccagttacaaatggatgctttattgccagacacacaaggaacaggaccacgttttgacttggccaaacagagacagcgtgccagtgagcagagcggacagcagggggggaaggggttgttaccttcagaagggttggctagagccacccacggagacagtgaagtgcgaagcccgggcaggtctcctgtgagcaggggcgaggggtgccaccatctccccgggctgccacttctggctggtttgggaacaaagcagcagcaaaggctggctggaccccacagtgtggttgcctggggaacagttcaggtcacccagagcaactgatttcttacactcagaacttaacaaactttagaaataaatgaggcagggtttgtggagagatgactccgataggatttaaaatgagaacaaagaaaatgggttagcagctgtgtgcctgcagatgggggcacgtttccaccacctgtggacagcacggcaggggagcagtggccagggcgccctgtcgcccccctctgagctgcaggacagccacaggagggccacagcaagggccatgatgacaaatggaagggcagaaggacgggagacactggctgagggctcatgtcccactggcatacgcacgctctactctcctggacgagaccatgatcactgtggtgttgatgacaggacttcctggaaataagcatcgtggatatccctaatggcagacaagccagatgtgggcagtaactaaggcttctgtctcggtcagagaaatgtgtgttaccaaagagtcagcaaatggaggcgacaaaacggtgacctcctaggacaaattatccagccctccagtgctgactgaacgctcaccatgggtcaggcacggctgtaggcacgggtgggggggggggcgttgagcagtgaacggtaagttcaacagtgtgaaagtggggatggatatggggcttctcacctgaaccgcaggaaatacaaagcccatagagatggccatggctgatctgccgcaggaaggaatcaggctgacttttgattggttcctggtgaggcccgtacatctgtgtcacccccatgcaggcccacggaatcaggaggtcacccgtttctggaacagctccgatagtgataaattgctaggtggcctgggagcccacaggcattatgtagactcatcatgagaaatgcctgtttcctggagcttatcaaaaaattccgcaacacattttacttttacttcaggtctttacgcctattctgtattgtgtgtacgtgggtgtgttctctacccaaaattcatcactgcagccttgaattctgggctacagcaattctcctacatcagccttttgagtcgctgggactacaggggtgcgccaccacacatggctaatttttacaattttttttgtagagatgaggtctcactatgttgcccaggctggtctcgaactcctggactcaagcgatcctattgccccagcctcccaaagcactgggattacaggtgtgagccactgttgggttgtttttcttttgaagtgttatctgttgggatttatgcttatcccttttgtattcagtcatcctagcatttctaaagttaggaagccactgtgtcaagagcgaggccaccaggccacctgccttatgtggccaatccatggagcaggggtggagggccattcaaaccagtcatttagcaggactgtgctgggtcagttcgatcacctggcctggagggcacgtcagcttggtgcaaaccctgcgtttgacaatcagatcgtgttggtggcagtctccgtgctgtcagtatcccactgaggacagaagggagtcccctctgcaatggcagggctctagggcatagtgcatggggtggactcctcatgggccactcagacagggcctggagaacaaagcatcccgtgggcccaggaaattgtccacctggctccacgggcctgggagggctgtgtgcatgggatggcaggtttacgaggaggagtgaggcctcctgccggagccccacctgcattcagcctgaggccaggccccccacctactctaactaccctgctgagaccaccccactactcacagacctgttcaagaaaaagttgtcctcagggtctctcacacactgggaaatctacttgaaatgtaaacattactttttctcatttttcataaaaggcaacaggctgatgttcatatatttctcttgaatgcggattcagtttcactcattgccctgtcttggaaatccccatgttaatgatggcttaaattaggttgatagagtcctcccttggagtccagcttggaaaatcctcactggagaggggcaggcccacttctctttttggaagatggttcctaactaaagaaagagggaccagattgggcccctggccctgcagtgcgtcccaatttatctgacgtagaaaccgggatttggaaaataccatcctggcttttctctggacttcacaatctagagggcgaggactgtggcccagtcaccttcccacacagtgcacagtagaaactccagacatgctttgtggagtggaaacatttccagtggcttctgactctagttcctgatgtggtttaaactaatttgggcagccatggcagcagaggccaggaacagtattcaatactttctgaacttgtgattctcccccaacctgatctgcatgaagctactttggaacatttgtatctgcgtaaaactaagagacctcagtacacccaatcccctcttccaacacatgtgaggtttccatgtgaaagtactttttcataggttacaataaattgcttgcagttacaaatttggaggtgtttcagcttgtattgtttcacgaggaatttcttaggggcacttggcctacaccctgtttttgttctagaattacctgccgttaaggtcagataaattttcagtaaacagattatggcacaaatcaatgtgtcctttcccggacagaagagatggctctctggccatgtcctaacaccagactgtccttatttaagaggcaggcgtgtcttttgtctaggttgtcttcaaatttaacccattaaaccagttaaccttatttcatatgtgaagggctttgatgtggacaagatgaggcacaaacttttcatataatttccacatttttagcaacaggtttttttctccaacaacagttttcatcataaaaggtgactaaaccagcaaatgagaagacaaataacattgaagaacatgagctattgaaacttactttttattattttttccagttacccagcatgccacaatctgattgctgacctggatggaacagagtgaaataaatgatttacaaagagatatttacattcatctggtttagacttaatatgccacaacgcaccacgaccttcccagggtgacaccgcctcagcctgcagtggggctggtcctcatcaacgcgggcgctgtccccgcacgcagtcgggctggagctggagtctgactctagctgagcagagctcctggtgtatgttttcagaaatggcttgaagttatgtgtttaaatctgctcattcgtatgctaggttatacatatgattttcaataaatgaactttttaaagacttgagttgtaatgtttcctttttatcttgtagtgatgaacaaaacacaccaaaaaggcacatattttaactaggccaaagtatattaaggaccaaactttttttcctgccattcatttttcttttcatgatctatatatcaatcatccttcacctttaatcaatgtcccatcagactccattttatttatttatcgtcctactttgtgcacaatcaatcaatcaggagacaccaggaagcactatgcattactctttccattctgttaaacaacgaaaacagacaaaaaagcatctttggctcggtggtgtcagatttttttcttcaatacgcagtatttgagaggagcctaaaaacgtacttagtgaaattagaaaatttacttagagtatatcaaatatctgtacacagataattatttgtctaaaatagtatttctactatacacaattaagccctcaaatgctttaaagtaataaaaacggacactggacataccgtgttgtatctgagaatgacaaacactaaaggcaaggctgcagttagttaggacaggtccctgaccttcggctgccctgcctggccagcgagccatcatcctcatcaccatctcaacacagagctgatgtcaccatatgctcagccttgcctctcagaagtgatgtggattaggctttggaggcggtggcatgatctacacacagagaccatttgaatctcttgagcatgtaaaaggttcaagcctgaaacagtagaacttctattcagattcagaagttttttatttcatcaaatgtgctagacataaaggctgtcacataagatattttaattgtccttaattctgttttagatatactgtgaataaattatacaatattctaaaaatagcacctttaaagaattatagaggtcacttttttttagcctcctggatctgtcaaccccagtggttttgagagaagagcacatgtgagaatgccctcaaatttggccgtgtgacatacacatacatgcttgactcactctggtcccaaaagccattcctctgtctggcttcgtcacaggagcaaagccaagtttctacaatagtagctttatgaggtaaaatcagaaaaaggccccatccagaatgattcaacgtgaagtcagactgcagtccagccatcctacccatctacatcacccacgtctaagtttgttaatttgccatgacatgttgttagaaatacactctaagaaaggaaatatgcagagcagtacattatcaggaagacgttaatgaaaagctacattccttcagattctgggtccaaaccgtgtgttgtatagatgattcgggtctgaatgtccccagggtctgagacctccttcatccctggcttcacagtacatccatcctaaatccagtgctgagaggtcagcgtttcccctcagaagcagccgttcatcaaagtttgcacaaccgcactactgccatttcactgaagtaaaaatgatcccctatgtgtgtgtgtgtgagctacaaggaattatttctatattttcctgtcacattttatacaaggtaggttaataccagctggggctattaaaaatcatgttttcattaaagaagatttaatttggggggattatagaaccacatccaacaacaataaacagagaagtagcagattgacatagtgctttatttaagctgtctgtacgaaggaaaatcatgttcatccctatcatatacgtgtaaaaatactaaggatgtacagtgtacaaaaacagtttctcctagttattccacatccttgtgggtcatatacttcaggaaatagacaggtttagtatgaccaacagtaatagtaatacagtttcttgggtttatagttgcatctgcttaaaatccttaaccagatgactagatcttgcgcagatctaatgaaagaactagcaaggtcaagaaatgtcacaaactataaagctacagggaggtaattcaattaccaatttagaggttttctttttatttaaataaatactttacatttcatgcttgcctgtaatgcactaccaggagcaagataaggaaattctactgtagacagtacaaacagtagcagcaaagtgtgtatgttgaggtgtaatagagagaccctgcagttagtaaggaaggcccttacttttgtactctaggagaagcaagtggcccctgcaagaacagtcagctttaagaagctggaaatcagggatgggaaatggaaaacaatacttgaataatgctatgtaattagtgtagaaagcaaagctgagcgcgaccctgccaaccatctaagcagaaatggccaatttcctccaagatggctgcattatgacaagaagtcaagcttcatgacagttagtatgggctggagtctgcaaagtctgaactgtattctcatagaatgattccaggtttcagggtgttccacctgccagaacccaaaactacaactatgggcgacacaagggaagttttagaaatctccctctacacgcatttctggttttctattattcctccatggcagctgacagatctggaagtgaaaataggggattctcaaaatcaaagccaagaagacaccttgtgtgacaccaatggagtctcagagggtggaatagaagtgactgagccccaggcatggctgggaactgagagccagtgtgaggagtggcccgcctggggcaatgtcagtgccagtcattaatctttaagaagtgtccttggccaaggtcatgggaatcactttaagatttgcgggagaaaaaaccaaaacaacaaaaagctgtgtgcttagtgttcggtgtcatgctttccctctagaggagtaagtgctctgaacatcagccagtctcagctttctgctcttcctctcacctgtttctttcttatataatggatgcaagacaacttaaagaacataccttctagtctacttttttgtcaaaatgaaacattcaacataattccaagtgaaaaaaaaaagattagctatgtgtgtaagtaagaatgaactaccatttactgtaacttcctactcaatactaaggatgaacttcactcaggtagaaatatgaaaaagaaggataacgttgatgtctgaatatgtcttagctgccttagtaaaatgccctttaacccccgtcagtcccagtggcccacccactgccagcagtggtttcatagctataaatccacacttccagcgtcaagaggctaagacatctgcatatgaatatgattcatcctacttagaaagtcacttgctctttcatacaatgcaatcataatactacgtcatgctgtagtcttccgtttgggagctgtcagagtttaactaaaatacatttccatgatcactccgcggagtaggatggccttctgcttgccgcaagagtggcccccagcccctaggacttcacaggctgctttggaaattgtcagctcctagcaccaaagggtttaatctgaagatcatcattaatgaaggagaaagatgaggtttgcatacatgccccctttcagtgagaaatgttggaatctgggggacatgagtatatacagaaaaagaaaagctggaggtgttctctttttttgttgttttttccctgatggcttaattcagtgataaatgtaccatgatcccaagaaacacaccaggttcttagccttcactgcccatttcctaaatactcaagatgtgttcattttgccacgtaaagatcatttcttatcttcactcaggtctcaattttcttcattactttttgttgccaggtcatcataacgtttcaaattcttaaatgagcaaacgtcaacagctatttgtttcattaaccccttggcatgcatagttggggattttctcattttcagtaccaaggggttaaatggcagcatctcttctcccaaagccaaattctaaccaatatattccatttcagagccttatcattttttttaacagaggagaaaaagtgcatgattctcatcagcgtgtacaatccttgcacatgggtcaaaagtaactgcagtaagtctattttatataagttggagctgcgtttgctaacatgacatacaattctcatcactaaaaaataaatactactgcaatataaacaaaatcataaaaggacattcaaagtttcaacatctgagaaaaagctaattcacgtagaactgaaagtaaaaaattaaataaggcaaacacctgtttaccttggtgtagaaattttggtgaaaagcagtatcattatacctgtctacattcttcagccatcagaggtgataaatgtcaagaaggaaaaaaggtttccaagcacaggggaaagatgctctctggctcaaattgtttcataagaccctttaagtgaccttgactgtgcatatgccttcagttcttggtagaacagtgttcacttgctcatgattgcccgtgaagtctcgacatccacatgtgatatgggcttcttctacagtatccaccaggaatttaaaaaaaaaaaattatatatatatatatatatcccaacagttgttcagtccttctaccaaatgcttcctaatcaattccagccacagcttagtgatatatgcctacttcacgcacggatctgatgtgctttacatatgcacgccaccacccttccacaattgcttgttctgaatttataaactaaatcttcttagtctagttagtttttctcttctagaaagttaaaaaatgtacctagaatcagtgtatctcatttagccttcactgagggaaaaactaaaagatcaaaagatgataattggtgcacaaatgaacaatggtgggctcatgacttccaaaggttggaaaattacttcttaaagttgctataatagtaagacagtagcagcaacagcatgagaccttagactgagatacaatttcatgcaaaaacaaaaactggagtgtatttgcgtgtatgtgtgttttcatgagggtgaaaggtggcgaggggtgaggacccttggctggtctgggatgtcggaaggtgcccctgctatgtgtaagagctaggactggtgatgtccaggaatcattttcagtaataaattgaagatgacagtgaagtagcagaatgaaagagacttattctcgtccacttgcagagtaggaaaattgagggaaatgcggccgcctctcattgtccatgcagtccataccatcctcatcatctgtgggcaggaaacatctattttaattttacacattcattttttgcaacattatctctagtctatgttttttaaactctgaacataggaaagatgaacagaggcaatagctcccataaacttgtgttcatcaataagctgtagagtaattatacttcaaaaatcatctgattttcataaatacatagtctatgaagaaataatactatagaatcatctctaagacatcaaaatttcaagactcaatgaaacagtgaaaaaaatggtattgaagaaaacagaagtttttaagaaggagcagtcttcagtaacctttcatttcatgtaaccacatatatcaaaactgcaagtcagtgaaatccacagcatccaaagtctgtatagaattcatcatcgaatgtcttcaagtgcttatattttttctttgtgatgctttaagtgcaactgcaaaataaagcttcttatgaaatttcattcaacatctagcatctggcttaactcacctttcccaatttccctatgataaaactttagcatgaagggactaagtgaaagaaaaagagggaaggatgtcaacatctgagtcctagctcatcaggaaacaatggaagagacttgaaaggcatcaaaacaggccgctgacaatcacagtgttcctcctgtcagctttcctggtttcctgtatttcaaagatcacagatgatcagcaccctgttctcataaatgtcctgtgatgacagtcctgtgctgttggaagctcttcctggtatgtggccacgtggtcagccactcagtcaacatgcgctcccacgcatctgctctgggctgagcacccgtcaggcccaaggaccgcagaactttgaacaaagtcccaagggccccctggcctcacagtctcctgggggaggtgctccattttaaatcccccgtgcttgcctctaagcttgtttaatcatatgctgtcctgcaatggaaatcagtgaatctttccaatactcaacccttttctcttcaagcaaaataattcgatgtcctcaaacccatataggaagtacattaccaatttttttgaatattctaacctctccagggagcatccgctggatgtgggtgtaaacaaagaaagcatacaggccagatcccactgcactgaggctctgactctgtcactccgaagaggagggggctctgcctttgtctgaagaataaacacttccattcttgtatcactgtttttcttttctgtatcccactcttaatgcagaagattctagaaatgggatcaagctggcattagccaaaatttctgacccctaatgtaccagaagatatcctcgtattaggtgagaactgatccatcaagaagcatttgtggctccctgctctgtgtaagacactgaactcggaggccctctcttcttctgcaaatagaccactgtaactgcagtcagcatttctagaaggtattgagatttggggaaatctctacctccttataaagttattggttccaatatttgtaccaagcaagtcacacacatcttttagatcaaataccttcagcagtatttttagctacagtaaaaacggaaggagctgggaatgatggtgtacccgtggttgagccccagagtataaaaactctctagagaatacgggcagctaaaaccttaatgttcagattctgacatgagccaatcacatttcaaataaacaattttcctcaccaacagctttattttactcagtgtttctgcacagcaaacctgcagctggctctggacagcagtggggagcctggtgcttgtcctgctcagccaggaagggcaggagctgcctggactcctggggccatggccaggactcattccagcccggcgaggttcagcacccaggttagccagatgctcaacaggggcaggtgctagacacccttttggaagaggagggactcttgctggtgtcagctaagaattgagagacagccttcattctgtcacttcagtaacacattcatcacaattctgaatctaggaaatttcacagatatccctgagggccccaatccttgatattctttaaagccaatgatctccctccatcattcctgcccctttctgttgtcaggcttggaaacaatgaggcgtgaacatctgatcatggccctaaaagagctgagagcctgggcaggggctgcggtgggaggggagctggaggaagtggcagctgactctgagtcggagcctgtcaatgtacacaagttagttcctgctgtgagaggctgtgcatagggaatagtgatgataatgaacatgaactatgtttttcaaaaacacttatctggaaaaagaagacaatgatcaactctacttgctacatcccttgaatccctgcatccaaggaacatcagttgcctgattttcttagaacatttaacaaatggcattatatggcagtaaaagcgaccagatctcaaagaaaccctctttttctgtaagaggaaggaggaggaccatcaatggcgataacgaaagatgacacattcccaaatctgttccattattaacgccagtgaggacaatctggcatgtcactgcagctgtttgtagaaaatggaacattttgcctttctaactgctgatttgttctaaacaataactgtattctgttttatacaagcaaggtggcaagtgggaagacaattgctaacgaatggtactaccctggacttttatcaacaaaacctctgtgtgttagcacttagggagctgcaacggtttcttaccagttaaactattcaaagctgcaagaaaaaggttatgttgaatgtaatcaccgttcaaggtttcagtgattctcattttatctgctccttaagggaatctaggatgtatccaggaactgtcaaactaaaaatactgccccgttgccctagaagaacccagaagctgcagttaaccaccatcaaggctgctcccctaagacaggaagcccagggccccatggcccccagtgctgagcgctgcgctctgctgagccacacagacagcaggagaggctgctgaacagaggtgcctgcagatgcgtcgatgctagtctttgcctgggcatactctgctgagctcttccgtctgactttccttgctacagaggtcctgaatagggaaaaacacagcaagtccatagcgccctccccacccctcaattgcggtgtgccctgtcagaaacagatgacattgctgggctctcgtttccgtactgtccagggcccaggagcagggcaggaccacaccccatttctgacacccacaaaagccagacttttttttttttttttttttttttttaaaagacagagtcttgctctgtcacccagactggagggcaatgttgtgatctcagctcagtgcagcttctgcctcccgggttcaagcgatcctcctgcctcagcctcccgagtggctggaatcacaggaatgcaccaccacgtctggctaatttttgtatttttttttgtagagagggggtttcaccatgttggccaggctagtctcagactcctcctgacctcaagtgatccacccgccttggcctcccaaagtgctgggattacaggtgtgcaccactgcgcctagacaaaagccagacttttgtggtcctacaattgcaggtggattttgataaccatcttgaaagttactacaatgtacaggcttcctaggtatctctgtctcaatctagaagtgaacctattatcatttaaagacaccaaggttgtagggcttttacagcatgatccatgtctgaaatgacacatgttatttaagaacagaggtgctgtcagtggtaaaatatgacatgccaggaaaaacattcttgatggcttttatattgctgattaatgaagccaaggaactaggttcaaattatgttctagaaactgtgctgggggacttctaacaccttctaacatttcagtctcattttagaagtcctagagattgagcaataaaatgcacactaatgacaaattctcatcaggacaagtgccccgcgggtgtcgagtaaggaataaagcaggtaagatgaatttcgaagagattctggtccttgaaagctagggctttgaaattcaagtcaatcatgaaaaaatgactgactagcctaagagtcatatacaacagtttctaattgaccttatttgtacccaaatccattttgatttgctctggtctttctagtctcacatttctgagcatcgcattagtcagccctgtccgccggccctccactacaccacccctgcagccaggtgcttgctgcgttgggcctatcatccccctaaatggactggcccacagcatacagtaacactatggactagccaatctggtgcttgagcagaattgaaaatagggtgattcaaattggcagaactctcggtgcctctcctaaagagacggcttctcaggcacacgggaggacaaaaacgccactgagagactatcagccctgctccctgcttttccaggggacaaagtgaccggccatcgcccagaactgtaaggggcacaggcaggacacaaggcaggttccccaggtctgagtcctgggctttttcagcctcactccatgtcccaaattgggatttcacttttagctttcttaagtaaaatatctactcctggcttgacattttagagccttcttatttctatgacttccaaaataacatatttacttgctctaaaggtacgcaaatgccaaatgctctatttaagaatggaaactttctcagaggctgagactgaggaaagagacctgtcaagaccttcctatcccaatatctgctttggatattcagaggggaggcaagcctgggtgtcctcccggctctgaagttcctaggccctcaccatattctgtgtattcatgcacctaacaagtattattgaatacgcacactgtgccaggcatctaactaggagcttgggctaataacgaatgagacaaactagatccttcctctccaacccactgcatgttagtggcggaaatagacactaaccaaacaaacagaaaaataccagcaagtcaaggtgccaatgcagagaatgaagagagagagggaatgttgtcagactgatgctcttcagactaggaggtcaaagaaggttctctgatggaatgacatgtaagcttagagctgaaggacaagaaggagccatccaagtaagatcagggaagaagagcattccaggcctggacaccataaatactgtccccagagcccgaggcatggtgacgtgtggcatgttcgaggtgtggctggaacccagggacagtgggggaagatggaacaggaagaggtcagagaggtggacagggcccagatcagtcagtgctgtgcaaaccagtgtgagcaagtttggatttagagtgcaatgggatggcaccggaaggttttaagcagaggaatgatgtggtctgattacagttaggattatatccaaatgaaagggcctagcaaaggctgtatggcaggaactgcccatgggccgatccgaaaactcactggtgttacccagcattttggacaattctaatgccacagtctatgctggggacagaggccaaggcctatgcccatgatttctactcagcgctgagctacttgcccatgactccacaggctttccaacattgtctgtgactcttagtgattctaaaattctagcaatggcacaagattgagtggaaactctgcctcaccacaggactgaccatgagtagctcacttcaatggattggtatttcacaacttagcctggacatcggtcaagttggtaagccctgcttctggctatggctgacccaacttcaggacctggagcaccttaactttttgtgaatctaaagaaagaaaagcacacacacgtcatcatatcttcactttcagggtgttcacaatccccttgtggccagaccatggtcccaagattaagacctcttggcccacatgaccccttgtttgcctctcgacagtagaatctgctgcctgtgaccatctctggcacagcattagcctccaatcgcccctctcccggacactgagtccacatcagcactatggataaatctgcctccaaaaaaggaatgagaggagaagacatatagggaaggaatcaaaaagaaaaggaaagaaaaactatgatgtgaacccaaagatgtgtaacttgaagcattcttgcagccatccaaatattgccctgaaacgcaatcttatccacattcttaagttaatgatgatacacacagacctctgtcagcatgaaaatgtttatcaattatgtctgatcaccttttccctcattacagctccacttatttatggtatttctccaagtgtgagacatactaatgtatatgaattgacttgaagtggtacatgaacacacagttttcataaatatgtaatttataggtatccaaaagtattagcaaactaaattatgtcttcacagataatactatttaagagagagctaagtaaaaaggagtgactctacatgaattttaaaactattaagtaagtaggagaccaaaactggcaaaattctgaaggttatgtgggaatgaacgaagtctaggaaagaggggagtctctatttcacaatcctttcagttggtgtcaaaacaatctattggtgaacagtaaggaagagctagtctgtaatttcatctacaatttctctctatataatttgtcctacccagaaaagcatttcttgcagtcttttgatattaccactgggaactcaatattcttaaattcaattcaatattcaatattcttaaatagaatggagtaagtcactgtggaatttgatcttgaaaatatcagatgagtttttaaaagactgttttcttcaattacattaggagaaattatattagaaatttatcaattgccttctaaatttacttacatttttcaggtggtgttattgtaatagtctgagctgtaaattcttcatcaaaatatctagtatctgtctcagatgttacttgaggtttaaaaggaggtacaagctgtaaaaagaaagaaaaagagttttattaactgatttcaattcaggaaaattcctttctaggaaaaaagcagagagcacgtagttaaatgaacagaacaaaagtctacaatgctgagtcgctgggtaagggagacatgatatttggcttcccagtcaacagtctaaaccaaccggtgggtaattggtggttctgtataaaatctaatggatcacgaaaaacaacaaaagaaaaccattgaataggacgggagagggatattgaaaaatctgtgctggtttttttccccaataacaaacatacatgcaaaaccatattgatggggagcagtgtgccaggatgtgggctcttcctcgggcaacctctttctagtgctagctgaagagggtagtaataaaaatacaacttaataatacagctatcaccaggttacagatgagagtgctgcctttgcccttcgtaaagaactacaactttgtactttgctaagaatttgctgataagagatgggcattgatgcctgccctgctctggaaaagggtttcctggtagcccctgacgttacatgcaaaatcttgcccacagctttcatcagatcctcaaaggggaccacagcccagaagagattaagagtagctcccctgagattgacagggcaggaatcatctcattcgcactgcacctgcggcaggcatggcgttagggaaggtgggggtggaaggaaagtctcgggctactggaggtttcaggagccggagccctgtgaacctccactggttgggagggagaaggagctaacacgaggctcctgcttctcagggctctagccttgagggacaggtggaacccacaggttccttctagcacaggatgcccagtcccagagcattagggtcagagtgcgtgctctgcagagtatcattcagaacaggggatgctgctttagaatacagttctcacggggataggaacatggcaaacagaatgacagaaatcagcatgttttataaaaattttacaaaaacaaatacacaattggcttgagatcagtgcattttcccactctttctgtcaccaaatgtatgttaaataataaggaaaatctttaaattattctctagacagaactatatttttaagaatcgtgggatgagcagaattaaaagcaggttttcaaaataagggacatttcagtttatggtacatgctacaaagcattcttaatctcttctttttataattctttctgtttacccccagcacacagctattctaaggtcttcatgattagcaagcactcctttggggatgaaccaactctacgttccactgatcagctggtaatggcgactaatccctaaactgaaacaaactcctccaccagtggcaaggagaagcctgccattgtgccagaccatatttctttctagctgccctgctggatcccctggacatgagcaagcaggtcactccactgctagaaaccctccctctgactctcaggctaaattctccacaccagcctcacatatcacatgcacacgcacagggaaccccagaggtgacagaggctggaacaattttgttttttttattttttttagaaaaccaagggggtaattgcccctatctggcagaaaacgggaagactggaattctggttgggtttttctgatttactattctacagatgttcacaaaataggtctttatctttccaatcagaagttaaccacaagaaattcctgtggctggaatcggcttctcttgggcactaggagtaggtttgctcacctctgccccatccttttcatctggttctttgtgatgtcaaaaatttaaatttgccttcaagttaggggaaacttgtccttttagatgagagaatgatgacctgtaactttaacaaactgaaacctatcttaacacagttttcaaaagattataggggagcttaaaatagtctctgtttcaaatgccacgtgtactgaggactttcctgaccgccttcttacattaaacagctatcctccccctcactttctatcttcacattgctttttcttcaagactttgcgacatctgatacacaggcacgtatacatgcacacatatgatatacatgtatttgttactgtcaatgttcatcaccaataaaatataagttccacgagggcaaggactttaaaaaaaagtttattgatgcgtaattaacatacactaaacagcacacattaagaatatacaacttgggctgggtgtggcagcgggcgcctgtagtcccagctacttgggaggctgacgtggaaggatcacttcagcccagaaggcagaggttgctgtgagccaagattatgctattgcattccaacccggccggggcgaacgagtaaaaccctctcaaaaaaacaaacaaaaaacatgcaactgatacgttttgacatatgtatatacccatgaaactgtcaccaaaatcaagatgatgaaaacatctaccacttcaaatgtcttcttgtgcccatgtgtacttccatcctcccatcccctgcaggccatgactgacatactttctgccatgactgatttgcttgtattttaaagaattttatgcaaatggatcatagagtatgtactctttatctggcttgttcatttagcattattactttgatattcatccatgtcaccacatgtatcaatagtttactcactttgctgggtaatatttcagtacatagatgtatcacaatggacacactcatctgtcaatgaacacagggcctgctcccagtttggggcaattacaaacaaaattgctattaacttttatgtccacgtctttgtgtagacatatgatttaatttatttaggacaaatactaaggagtggaatggctgggccgtatggtaggtatacatttgacttttccagaaactgtcaaattgttttcctttaccatgttaaaaaaaaaaaaaacccaattcctaattcactcagagcgtttcattttttgtttaaataagttttaaaaaggatggatttttcttagttttttctttgcatcatttgatataatcatttccttcgtactctgttaataggtgaactatagtgattggttttgaatgttaaatcaatcttatattcctagaacagaccacactggtagtgattctttgtatctattgttagatttgatttgctaaaattaaattaaacattttagcatatatattcattaagaatattggtctatagcattcttttaaaaatctctttgcgggccaggtgtggtggctcatgcctgtaatcccagcactttgggaggccgaggcaggcagatcaccaggtcaggagatcaagaccatcctggctaacatgggaaacccccgtctctactaaaaataccaaaaattagccggctgtggtggcaggtgcctgtagtcccagctactcgggagaatggcatgaacccgggaggcggagcttgccatgagctgagatcgcgtcactgcactccagcctgggcgacggagcaagactccatctcaaaaaaaaaaaaaaatctcttgcatattgatatcaagttaatacctgcctcacagaatgaactgagaaatgttctctcatcttcaattttctggaataatttgtatagaactgataatattccttaaatgtttggtagacttcgttggtgaaaatatgtgggtctggtgtctttgtcagaaggatcttaaccacaactataatttctttagcaggtacaaggctattcatgacatctatttcttcttggtaatttgtatctttcaacatatgtgtccatttcagctaaatagttgaatttattggcataaagttatacataatgcttccatattatccacttaataccaatagaatctgtagcagtgtcaacatttattatttgtcttctcacttttcttttcagtcaggtgagaaatacatcaattttaatgatcttctcaaaagcccagttttcctttcatcaattttctctatgattttttgttttctatttcattgattgctatcccaatctttatttcctttgttctgcttacactgtgtttaacttgttcttatttttctaattcctttttctttttcttgttttttagagacaaaatctggctctgtcacccaggctagagtgcagggatgtgatcatagttcactgaagcctcaaaactcctggcctcgagcaatcctcctgcctcagcctcctgaagcaatcctcctgcctcagcctccttgagcaatcctcctgcctcagcctcctgagcagctatgaccacaggtgcacaccagtatgcccagctaatattttgttatttagagatgggatctcactatgttgtgcagactagtctcgaactcctctaccttggccttcaaaagtactgagattatagttgtgagctactgtgcccagtcctagtttcttaagatagaagctaaggtcattaattttacacttttcttcttttctaatgtttaaaaatatcttttagtactataaattgtatttagtactataaatttaagtattgctttagctgtatatcacagctaaacacattgtgttttcgttttcagtccattcaaaatactttctcatttccctttgatttcttctttgatccatggattaatatttagtttccaagaacttggggattttccatagatctgtgtttttttaatttcatttccttcaaagagaaaatgttttacagtacttaaatcctttaaaattcatggagttgttttgctcaacatatggtacactgtgataaatgatctgtgaccttgagaaaaataagtgttcttatgctgttgggtagcgtgttccataaatgtcagttagatcaagctgactgatagtattgcccaagttgctatataaccttaccaatttctctccaattgctgtatcaattatttgaagatggatattgaactgtccaatagtaactgtaaatgtgtctatttttccttatattagtttttgcttcaaatattttgttttgttattagatgcataactaagacggttaatacttcttgatgaaatgactcccttaattattatgaaatgttcctccttatctccagcaatattacttgctttgaaatctacttcatatgatttaatatagcactctagttttcttctgattaggttgagcatagtatataattttctgttctattaattttaatctacttatatcttacatttaaagttggtttcttataagcagcatataggtagttcttgctttttaccaagtctaatctctgtctttcaattgtggtgtttagaacatttacatttaatgtgattattgatacgagtaagattaaatttaccatcttgctatttgtttcccacttgtctcctctggaactttgtgttgcactaatgtgatattcccaactcctaaaacagtccttgccacatagtagcattcaacaatatttgcggaataaatgaatcaatcattcagtcttgcagctgagtaagacgtcagtgagcatgtagtgtacctttttagagatcaggaaattaaagctgacactggttaaatggcttgccaaaaattatacgaataagaactggagcggcaaaaacctaggtttcttgatctcaaggtctttttactgtagcatttacaatgtgaaggctttgaatgaaaactacttttgcttttgattgtttctctatacattagtcaagatattcattctaggaagcattattcccccttccacttcccctgtccctgaaggtgaagacaactcagtggaatataaacatttgtagggaagcaaagaccctacattatgtatatggggaacattgtcgggtagggcttgtaaaaaattgcctcagtatggctgggtgcagtggctcatgcctgtaatcccagcactttgggagtctgaggcaggcagatcaggagtttgagaccagactggccaacatggtgaaaccccatctctactaaaaatacaaaatttagttgggtgtagtggcacatgcctgtagtcccagctacttgggaggctgaggcagaagaatcacttgaacctgggaggtggaggttgcagtgagccgagatcatgccattgcactccagcctgggtgacagagcaagacctcgtcaaacaacaaaaaaaaactgccacagtacttgaacagaagcagtcccacaaaaatcatcagaatgccccaacttcagatttcattacaaatttctagaatatataatattcttgagtagtcttcataaactttatggaaaatgtgtattatgaaaaaaccatgcacagatttcaaaaaatttctgcaccaaaattaactcatactgatttgttataacatgactgtacaggatcaagtttgagggactaagaaggataagacatcagtttggacagagcccctgtaagagcaacatgaattctaaaattgaagcaagaacaaacatgaaattcatggtgaagcttgggtggaagaatgattaaatcactgatgctttatgaaaagttatgggaagtatgccccaaataaatcagcagtctaaaaatggataacttattttaagaagggatgagacaatgtggaagacgaagccagcagcgacagaccatccacatcaatttgcaagggaaaaaattaatcttgtttgtgccctaattcaaaaggaccaatgattaacagcagaaacaacagccaacaccatagacatctcatctggttcagcttacagaattctgactgaaaaatttaagttgagcaaactttccacttgatgggtgccaaaaccattgcacccagatcggctgcagacaagagcagaactttcaatggaaattttaaacaagtggaataaagatcctgaagcatttctttgaagaattgtaacaggagatgaaacatggttctattagtataatcctgaagataaagcaatgggtatgaagaagtggaaatggtccagtcaaagcaatattggacaggtcaagggcaaaggtcatggcaacagttttttgggtgctcaaggcattttgcttattgactttctggagggcaggagaatgataacacctgattataagcacttggagaaagttggccaaagctttggcagaaaaacttctgggaaagcttcaccagagagtcctcctccaccaagataatgctcctgctaaatccctctcattaaacaggggtatttcatgagagctttcatgagaaatcattaggcatccaccttacagtcctgatttggctccttctgacttatttttcccctaaacttaaaaaagcttttaaagagtattagtttttcttcacttaataatgtaaaaaaaagactgcactgatataggtaaattaccaggatgttcagctctttagggatgaactaactagctggtatcatggcttacaaaagtgtcttgaacttgacggagcttatgttgagaaataaagtttatattttctgtttttatcttttaataccattttccatgaactttttgaagtcccctcatatttactttaaacaacagctgaacaaatttcaaatattgtattattataggttgaaatgtgtccctccaaaattagtatgtttaaaccctaaccccaagtacctcagaatgtgactctatttggagataaggtctttaaaaaagtaactgcattaaaatgagatatcaggatatgtcttaactcagtctggtatctttacaagaagaggaaatttggacacccaagtagacacactaaggaaaaaccatatgaagacacagggaaaagacggccatctgcaagccacggacagacacctcagaagaaactaaccctgcctgcaccttgatcttggactttcgccagaaatatgagaaaatgaatttctgttgtttaaaccacccagtctgtggtattttgttacagcagccctagcacataaatacattaatttcctatttcagctttaaaccagtatcttcatctcttcttttcctctaaccacatctctcaaaacatttctgtcaactgactgaatgtaaattcccatttagaaaagatagtcatatatatttctgtaaatctcagctacttttatggatcaactcaatgaacagctatagtgtcattaactgcaaacaacatatttttctgacaaatgcactaaacttgaaacaaatctttatttgaaaaccaatttgctttcagaaaatgtagtattcagtgatcttaaacaagaggataaagtttctgggttcaagacatcaatttcatctcactgaaaatatgcaacttcaagtccgtatggtgacagcaacgttgaagctccctaaattctttccacactgatcttttatcaaattttaaatgctatgaaatcactctaccatttactatcttcctaaaagtgtcaatgaaagaacaaagagataattttctgaaggttgttagagtaagtcacatttggtatttctggtatggctggaatgattccatgagtgtatgcatgaacaccaaggtctctgaaggtaagagattccacagaccttttttagtaacaagtcacgtgctactatcagatatctatattctttcttctattgttccttccaggggcttaagaaatagactggagaacttgaaactttctgggacagctgatgtggacagtgattgtggtatcttaattgccttaacaactgtggttatttccaccactttgtgttggcatatagggtccaaaatccagtgaacatagatgtttgcagtaaagaattgccaacactattgcatgtttagatttcccagagacagtaatctggtgctataattttcacttctctgaaacaacatgagaaagtagtcaatcataggtggagattctggtttatttaatctctactaaatactggcttcacgctttgtgtatatgtaggtgtgcatgtactggaaaagcaggagtataaaagaggatttatttctaacaaaactaatgggtatgtggcatacattatttagttactttgtatgctaagctgtgccataccaatgaattcttcttgacataaaactagaaactaaaataattatatttcatttttacaaaactacacagtaataattgaagttcatgctgttaatcttgtgcctacataaaatgtaccaaggggcccaaggtatataacaaattaatataccactattgtatcgtaatattagacctgccaaaatgagtactttaactataaaagacattaaatgtttaattaatacatctgctttccttgttggaattctgaggggtttgttaacacatgatatggatgatttgcattactttaaaaagtaatccccagaaactggaacttgtattttcttttctgtgataaattttctcattcaaaaataacttcataagcactcatcctattgactgtaggtttatgcccaggtgatgttattcacaaacatccatagatacgatacattatttgaagatctcagttatacctggagaggattcacctataaattacaacaaaagggctctcattagtgaaacactgggagcctttttaaaaggcatgagagggtaacaaaaagattttgcacctagtagtgttaaaggacaagttgcatttattataactatcagaacttcactaagagcctagtgaaacaatctactttctcccttcttcagctgattttataggctctgtccaacatcagcagtgtggcagccattaatcactatttctcttagaaatattcaagaacatgagcaaaagttgaataagtatgcagactggggagaaatgacataaaggcaatttccaacttacaagctaattttgttataaaagcctatatatgtaaggctgggcacagtggctcacgcctataattccaacaatgtaggaggccaagttgggcagatcacttgaggccaggagttcaagactagcctgagtaacatagagagactccatctctacaaaaaaatttaaaaattacccaggtatggtagcatgtgcctgtgatcccagctacttgagaggctgaggtggaaggttgagggtgaagtgagctgtgattgcgccactgcactcccctgggtgacagagagagaccctggctcaaaaatttaaaaaagaaaagaaaagaaaaatgcagcctacatataaactggaaaaaacttgggacctgtttcaatagatacacacacatacacagaaaggctatataatgtaggtaggttactaggcagtaacattaaggtctattaaaccagaaataaataaaaaatataacattaaagcttctaacaagtatctattatttttatagagaaattcctattatatttctgtaaagatgacgtgaccaagaccctctctctctctctgtccaggttctagcactgacagccacagccactctcttaataccacaccagatgaatgctggagagacccagtgatagggaacatttgggttgggggatgaacttgtggtgagaaggaaagataggggctttaaaagctgaggaggaagaggtagaaggtcaatttgaggcataggggcaggcagcaatttctatgttctgcaaggaagctattggagaaaagaacctgtatttatccagagctactatgcccaggtgctgtactaattaagtgaatgcaggaaaccaactggaattttatgaaggacacagaagatgcaagctatgttttgaagctctggctccaaaaaggacgaacacacacacacacacacacacacacacacacacacacacacacacacctttcagaaaccaattggatatccaaggctccccttgcaggtttgtactgggcagctaaacatcagaacaggaacaggcaaagaaatcacaagtagtacttcctgttagcctggtaaactctcaaacaggactttaaatgatctgaaatactctattccctaaaaagaaaaaagaagtatgttttttgagcatctcttcaatgtgtctttaaactgacaaaatattcacattgaaaataatcttatagatctagtccaatcccctcattttaagatgaagaaaacactgagcccctaaatattcatactaaagtcatactaaagcatcacaatatcaaccaccacccaattaattttaatccaatcctaactgcagcttctataacaggtcctttactcttaaaatctgggtcaggcaacctctgaaatacttctaccacctctgaaacacaacccgcatcacatgaaaatgtaaatcgcctgcttatttatctgtctcttctactaaactgtaagcaaccgtttgaagacagggactttatcttagctatctctgcaaggctagctgttggcacaatacttaccataaactacagtcatgtgtcacttaatgacaggggtctcttctgagaaatgcatgttagttgattgtgtcattgtcaaacatcatggagagtacttacatacaagcctagatggtgtaacctacaacacacctaggccatatgggatggcctactgccctaggctacagccctgtacacgttacagtgctgaatacggtaggcaactgcaacacaatggtaagtatttgtgtatctaaatgtagaaaaagtacagtagaaatacgctattataatcttatggaaccactgtggtatatgcggtgtgttgactgaagcatcattatgttgtgcatgacttacagaaaagcactaaatatttggtgagtaaagacaagaaaatattcacaggaggttctttggtgttttggccactggtgccaaacaccaagcaccagcctctgctgactcctgaaccatacataccaggcaccagcctctgctgactcctgaaccatgcatgcacagggaagcctccaagctccctagtgaagtctaaaaggcattgtcaaaaggtaatgaaattacacgttctctaaaaagaggtctgaatttgttactgagaattgggacaaaagagaaggggaacagccatgaattatgttttggctgcactgaactaaccataacattcactggtaattcacactgtttaaataagctctctcacacaagctctttagaaggttgcacaaacgtgaatctgtgagatacttccttgcatgaatacaaaacactgctgtgccacatgaagaaaaggtgtacatctggcatgcaataatgcataattaagaacaaatactcagtttcacttacaatcatggtcaagcagctccgattggattaaccctcctccatataactgtaacctcaggagaaagacatgaaaacaatctaaaggttctgggaagcaactaaaaacaggcaggtactaaagaggaggtgggcactaggaataaggaatggcaccaaatgaatttctcatttttacggctttttgcctgaaggtgggccccagcttatgccatttagggtaaaaatcttaaattagaaacccacagttctactgccatgaacaatcagaggacagagcttgaacaagtacagcagcttttaagtgaaggaggtgaaattccagaaaagaggcagccaaagagaagaagccctaaaatctcagtataaagtctgcccagatctctgactcttgaaccacacatgcacagggcaggctccaagcctcctagtgaagtctaaataaaccagcctggaatcttaacccactggaaaaaagaaagcgtttgcagtttgagttcatccatgatgactggcctaagaaaataaaaaattcagtattctttgctgcaacctaaccgaattcagaggcacaaaataccagtcacaatgcccaggatatattccaaaatgactcagcattaaaaaaacaaaggaaacagaacccatacactagaaaaagacatcaaaggaaactgatgctctgatgatctcatgttgaaattagtagacaaagactttaaagcaactttataattatcttcaatgacgtaaagtaaaatatgttcatgagtaaaaaagttgaaaatctcagcagagacacagaaactattaggaaaaggaccaaatggaaaaacctaaaataaaaaaaaataaaatatctgaaataagaaattctctctatgggcttggagcacattggagattatgtaagagtcagtaaacttgatataccagcagagattattatccaatttgaatagcacaggaaaacaatgtgaaaaaacaagcagaacttcatacctgttggacaacttccaaaagtaagaaagaaagaaagaaagaaagaaagaaagaaagagagagggagagggagggagggagggagggagggggaggaggagagatagataataagacagaaaatatatttcaagaaataatggctaaaagttttccaaagttaaagaaggatatgcaagagattcaaaaagctcaggcaactccaagcagaataaatagaaaacctcacctaaacacattatagtcaaaaggcttaaaaccagagtctgtcacggttccatgagagaagcagaactactctgtgtgtgtgtaaagagattacaggtaactgaatttccctgattgtgggagctagttatgttgtctctgtaaggctgttgtctccaagttcactgctgaggcttcatgtccataggacagtaagttgagaagcgaagatgcaagcaaagccaggagaggaaagatgaaatggaatctagaagcacaagctggagcccaggaggatagactgaaacccgtgttaattcgtaccgcctgaccttgctggtgtggatatcctgcaaaagctgggactttcatcatggagctaaacacacactccagcccagaagtaggctcaagggctaacaggatgcaggaggaggtggagctgatgcaggcctgaccactgccacgtaccaataagatggtctagcagacaacatgaatgagctacaaaatggctgttccgtcacgtctatcctccaaatctcccacgagaatcttaaatagcaaaaggaatcctgggaaaggtggctcagtctagtcaactgacatattacaaagccatcacacaaacaaaaatatcttgaaaacagccagtgaaatataccacatgacttgcaaggaagaaatatttaaatatgtactcactaaactatcaacccacaattttatattcagtaaaaatatcctttaagaatgaaggcaaaataaagacatcatcccataaaagaaaacaaattttttgccagctgcactacaaaaaatggttaaaaaaaaaaaaaaaaaaaaaaaaaaaaaaaaaaaatttagactgaacaggaattattccagacgaaaacatggatctttaagaaaaaaaaatgaagaaatgaaagtgttctcaaattagacagcggtgatggttgcataagtctgtcaagaccctaaaaaccatggaagtgtatactttaaagggtgaattatctcaataaaaaattaacaaaagaataacactggaaacagcaaatacgtaagaaaataataaatactaagagtcctaacttagaatctgggacagatatgaagattaatcttcaaacagaaacacagatgtttaatgaataaaccgaaacacttaaaattaatatagtaaggtctggaagattcacttaggccctttcagaggagacattatttcattgaggcctctctgtgccttgcacatgatagataaaaatattacttatgtaatcagttgccatcctattgaaatgagtatcaaccaagtgaccaaaataaactataaagtacctaaattactctctagaggcaagattttttcttcttttctgaaggaaatctctgaaagataagtaggaatgcaataagtattaagatccatttcaaaataatccaaacattctaaatcaatcttcctagaatacctcttaaatcttttctaagttgtgctttatataatacttatataattatgttttataatcattataattttttctttcgaggaacaaggctttagcagtcagcataaaattgggctttgggattttcaacctcagctgggccctccagcaatcggtacctctttataggtccctacttgggtttctctctagctccctctgagcctatccctacatgtgacagtcactgtcttaaaacttctaatatcaaccataaaacattcttctcactcttaataagaaggcagaacttctgccataaagatggtgggacttatacctgtaggcccagctattcgggaggatcccttaaggccaggaattcgaggctgcagcgagctgtgatcgtgccactgcactccaacctgggcattacagcaagactccatctcttaaaacacacacacacacacacacacacacacacacacacacacacacacacacacacacacacacacacagagagagagagagagagagagaatttgaggccttcagtcagaaactaccataactttctgcctaaataccataactttctgcctaaatgcttataaacacatctgctctggtgggcgtcttacttctttccaattgatgtcactacaagggtatcccacctcctttctataggttagctatgcttcagagatcttacatttttttctgtatttactcactttacatcttactatctgtatgtttttatcttaaatattacttgtttctatgtagctccaatttcacactcccttttggatcattcctgagtgtatgaaataaatatcacccattctacatgctccctttagctactgctcctttcttaactcttcaattttctctattttttaaattttaggttgagtggcacacacgtaggtttgttatataggaaaactgcatatcatgggggggtttggtgtacatgtcattccatcacccagataataagcacagtacctggtaggtcgttttttgatcttcaccttcctcctgccctccaccctcaagtaggccttggtgtctgctcttcctctctttgtgttgatacgtactcaatgtttagctcccacttgtaagtgagaatatgcgggattttgttttctgttcctgtgttagtttgcttaggcttatggcctccagctccatccattttgctgcaaaggacatgatcttgttctttttgatgactgcatagtattccatggtgtatctgtactacattctttatccaatctgtaattgatgggcatttaggttgatcccatgtctttgctattatgaacagtgttgtaatgaacatatgtgtgcatgtgtctttatggcagaagaatttacattccaataatgggactgctgagtcaaatggtaattctgctttgagttgagatattgccaaactgctttccacagtggatgagctaatttgcatttgcaccagcagtgtataagtgttcccatttctcacaatcttgctagcatctgttattttttgactttgtaatgagggccattctgactggtgtgagatggtatctcacagtggttttaatttacatttctctaatgattagtgatgttaggcattttttcatatgcctgttggccacatgtatgtcttcttttgggaagtgtctgtccatgtcccttgcccactttgtaatggagcttttttttttttttttgtaaatttgtttaaattccttatagattctgaatattagacctttgtcagatgcatagtttgcaaatattttctcccattctgcagaggtctgtttactctgctgatagtctcttttgctgtgcagaagctctttaattaggtcaagttttgtttttgttgcaatggcttttggagtctttgtcatgaagtctttgccaaggtctatgtccagaatggtatttcctaggttatcttatatggcattttttataattttaggttttacatttaagtctttaatctatctcgagttgatttttgtatatggtgtaagaaaggggtccagtttccaccttctctgcatatggctagccagttatcgcaatatcatttattgaagagggagtcctttccctattgcttcttactgttgactttgtcagagatcagatgtctgtaactgtgtgacatttctgggctatttattctgtcccattggtctatgtgtctgtttttgtaccattaccatgctgttttggttactatagcctgcagtatagttcaaagttgcgtaatgtaatgtctctggctttgttctttttgcttagtattgccttggctattcgggttctttttcgggtccacatggatttaaaaatagtttggtttttttttctaattttgtgaagactgtccttggtagtttgaataagaatagcactgaatctgtaaactgctgtgggcagtatggccatttcaacaatattgattcttcccaaccatgagcatggaatgtttttccatttgtttgtgtcatctctgatttctctgaccagtgttatgtagttctcattgtaaagatctttcacttccctggttagctgtattcctaggtattttattctttttgtggctattgtgaataggattgcattcttgattttgctctcagcttagatgttgttgttgcataggaatcctgatttttgtacattgattttgtatcctgagatattgcttatgttaatttgtcaatttttgttaggttgtttattggattgtagagcttttgggcagagaaaatcgggttgtttaggtatatagaaccatactgtctgcaaacatggatggtttaacttcagcaaatttttaaaaacctgaaatcataccaaccacactctcagaccacagcacaataaaaacagaaatcaatactaagaaactctctcaaaaccatataattacatggacattaaacaacgtgttcctgaattacttttaggtaaataatgaaattaaggtagaaaccaagaaattctttgaaacaaatgagaacaaagatacaacataccagaatctctgggacacagctaaggcagtgttaagaaggaagtttatagcactaaacgcccacataaaaagttagaaagatctcaaattaacaatgtaacatcacaactagaagagctagagaaacaagagcaaagcaaccccaaagctagcagaaggcaagaaataaccaaaatcagagcggaattgaaggaaattgaaatgcagaaaaagtacaaaagatgaacaaatccaggagttggttttttgaaagaattaacaaaatagactgctagctagaataactgaaaaagagagatgatccaaataaacacaatcagaaatgacaaaggggtcattactactcttcaattttcttgagtagcctaagcttggtgttctatttcttttaacttacacttgaattgaaaataaaaaaagaactagtttaagcattaagagtagaaaataagataaccaaatctaatggatgttaacattgtactatatgtattttcaaacatctgtttttttcagatgtaaaatagttactgctaaatacctaccttcttcctactcattgatgttcaaccattctatctatctatctatccatccctctctctatcttttgagatgaggcctcgttctgtcacccaagcttggagagcagtagtgtgatcacagctcattgcagccttgatctcctgggctcaaatgatcctcccacctcagcctcctgagtagctgagactacagtcgtgcaccaccatgcccggctaattttttgttatttttggtaaaggtggggttttgccattggtcttgaactcctgggctcaaggaatcctcctaccttggcctcccaaaatgctgggatcacaggaatgagtcactgcacctggaaatgttcaaccattttaacctgtgagaatggcaatcacctatgattcaagcaaatattgtcctgaagttacttcatatcatttgcatgcaagtttttatagttttctcccatatatatattttgtcataaatacaatgctttttatggtgcattttcagtttttgtagtacggtattctgtaaatatcctcagtattttgtttttctgtgtttgttttttgagatttatcaatattgatacttataaatttgagttgttttttattcttgaatagtattctaccataagattaagaaaaaactgcactgaatctgtattatcattttgagtactctcatcttaaattaaatatccaatatataaacatgagatgtctttccattcatttatgtcttcttttatttctttcagcaatgttttgtagtcggtagtgtataagtcttgtgcttccttggttaaatttattcctaagacattttttgatgctattttaaatgaaattgatcttcttaagatcaattttacattgttgatagctagtatatggaaatacaatgtattttctagcttgcttttgcatcctgcaactttactgaatgtattagttctaagcacaagtgtggcacgtgtgtgtgtatgttttagggttttctacatataagatcatgtcacctattagtaggggtagttttatttcttccttgcaaatttgattgctttttatttctcttatttaactcctctggctacagcttccagtgtcacgttaacagaaatgttgaaagtggtatctttgttttcttccttatctcaggggaaaaactttcagtctttcaccattgaatataatgtgagctgagggttttccaaactatagaaatgatcccttaaaggacagtctttccaagaatttttcatatatgacctttataatgttgtggcagtttccttctattcctagcttttttttctttttactgtttttatcataaaggagtgaattttgtcaaatgctgcccatcagttgaaatgatcatgcaagttttctccttcattctattaatgtgggacattacactgattaatttctatacgttgaacatccttgcattcctggaataaatctacttggttaaggtgtacaatcctttaattatactgctgaatggtttgctagtattgttaagaaattttgcatctgtattcattagggacattggtctgtagttttcttttcttataatgcctctagttttgacatcaggataatgctcccttcatagagcaagtgagagagtgttcactcctcttcaaatttttggaagagtttgagaaggactggcattaatttttctttaagtgttgggtagacttccccagtaaagccaactggccctgggcttttctttggtgggaggtttgcgattagtgattttatttctttaagagttacggggtctatttggattttcaatttattcttaagtcattttggtgatttgtgtatttccaggaatgtgtccatttcatctaggttactcaacttggtggcatacacttcttcagagtatcatcttataaccctttctatttctctcaagtcaggagtaatatcttttttcatttctgattcagtatttcatttttctctttttcctccttagtcaatccatttaaagttttgtcagttttgctgatttttcaaataaccaactttcggtttcggtcattattctctattgcttttcaattatcgatttcatttatttccgttgtaatctttacaccaataaattggttaaccaaaataatgaagaggtaaaactaccaaaaagatataacaatactacaatttgggtgcatctacacatggaactaaaaaaatgtcaaaactgatagaactataaacagaaatagtcaacgccataattatagttgaaggtttcacttctctcttagtaactgataaaagcaagccattaagctatcagtaaagatgcagaagacttaacactattagccaattctatcactgacatttatagaatattctacacaagagcaaagtacctatggcaattgtactatctgtgaaatgaatggtgctatttaaaagaggacttgaattagttataagtgtatacttcaaactcaagggctggcagttaaaaaaagttaaaaaagcataatttattcaattaatatgttatgagagggaaaaatgttgccttatacaatgctcaattaaaccagagaaggcagaataaaaatgggatacacacacacacaaagaaacagcaagggcaatggataaaaaactgtaagaaggccgggcgcggtggctcacgcctgtaatcccagcactttgggaggctgaggtgggcggatcacgaggtcaggagatcgagaccatcctggctaatatggtgaaaccccatctctactaaaaatacaaaaaattagccgggcgtggtggtgggcgcctgtagtcccagctactcgggaggctgaggcaggagaatagtgtgaagccgggaggcggagcttgcagtgagcccagattgtgccactgcactccagcctgggcaacagagcgagactccgtttccaaaaacaaaaagaaaaacaaaaaaacctgtaagaaatccaactgtatcaattatcatttttaatgtcagtggtctaaagacatcagctaaaagacagagacagtcagagtagataaaaaaaacaagatctaactatatggtctacaagaaacccactttaaatataaagacactgatagattaaaagtaaagggatggaaaaaagataggcatgctcatagtaatttaaagaaagtgggaggagctatattaatttaagacaaagtagggcaaggaaaactatcagagataaagaggggcattacataatgatacctgggccaattctccaagaaaacataacagtccttaatgtgtatgtgtctagcaacagaatcaaaatacgtgaggcaaaaactgatagaactggaaggagaaacagatgactctactattatagttggacacatcaacatgtccccccagtcagttaaggacataactgaactaaacagcaccatcaatcaactggatttaatatcaacattatggaatattttatccaagaaaagcagaatatgtaactcttctcttctcacacagaacattcatcatgacagaccatgttctgggccataaaatgcacctttaacaaatttttaaaaatcatataaaagtatgctctcagaccacaatgaaattaaactggaaatcagtaacagaaagatagctggaaagctccaaaatacctgtagactaaacaacacatttctaaacaacacacatattaaataattcaataaaacttaaaactatttgtaactaaatgaaaataaaacatcaaaatttgtgagatacagttaaaataatgcttagaggaaaatttatagcattgagtgcacaaattagaaaagatcgaaaacaaataatctaagctttcaggttacaaaactagaaaaagagaaaattaaatccaaagtaaggagaagaaaagatataattaaaattagagcggaaatcaatgaaacagagaacagaaaatcaatggagaaaaactaacaaaagcaaaagccagatctttgtaaatatcaatgaactgataaacctctagacatgttaagtaagtgtatttctatcagctcccttgcataaattttaaaatataaaattaaaaattttaaaatatattttaaaatatatttaaaattttaaaataattttaaaatatattttaaaattattttaaaatatattttaaaaatttcaatagctttaggggtacagtggtttttggttacatggatgaattgtataatggtaaactctgggctttagtgtacccatcacccaaatagtgtacgttgtacccaacaggtgacttttcatccctcacctccctcttccatcctcccctcactctgagtctccagtgtccactctactactctgtagacctctgcatacccatagcttagctccaacttctaagtgagaacatgcagtatttgattttctgttcctgagttaccccacttaggataatggccttcagttccatctatatgctgcagaatacattattttgttcttttttatggctagtgatattccaaggtgtgtctgtgtgcacatcccatttactttatccactcattggctgatgaggacttaggttgattccctatctttgcaattgtgaattgtgctgcaataaacatatgagtatatgtatccttttgtatagaatgacttcctttgtgtagatacctactagtggaattcctggatcgaatggtacatctactagtagttctttgagaaatctccatactgttttccacagaggttgtactaatttacattcccaccaacagcatgtaagcattccctttttaccgcatctacattaacatctattgttttttgacttttttaaaatgaccattctgattggggtaaaatggtatctcactgtggttttatttggtagtttcctgatgatttgtgatgttgaacattttttcccatgtttgttggccatttgcacatattttctttcgagaaatgtgtattcatgttgcttgcccactttttaatggaattatttgaattttttcttgctgatttgagttctttataagattctgggtattagccctttttcagaagtaaagtttgcaaatatttcctcccaaactgtaagttgtctatttactttgttgatgatttcttttgctgtgcagaagcttgtgagtttaattaagccccatttatttatttttgtttttactgtatttgcttttggggacttaagtcacacattctttgcctaggtcaatctccggaagaatttttcataggttttcttctagaattttttatggtttcaggtcttacatttatgtctccaatccatcttgagttaattcttgcatttttaatagtgtttgttttgtgcatatagatgctgttatttggtgcaaataaatatgtttctcatttatgctacacatgatctacttatcacgtttaatatctgaaatctacttagcctcaaattattattgttgcctctgtttactttttgtgtcatttgatgattaagcttttcctcattcttattttttccagtttgctgtgtaattttattctaggtgagattttttgtaaggaacatctagttatatttcctaacccaatttgaaggcttttaaagctttaactgtatacattttatgccagaaataacactggttttgacagctgtttgtgtttttatatcctaagtacaatgcctcatgaccaaaagaagacactaattgtaaggcttagccatcagaatgtctagcaggtatttggaacacatctttctttgaccccaagtttaaaagtgggccattatttgagtgtgataagggaagtatcaaatagaaacctattttcagcctttcatctctcttccgctggtgcatctgttctactcctctggccttgcttcacttgtaaagcagtagcttacaatcattaacctctgcgtaactgccatcaatcaccgaactcttcaggctgaatatctcaaccagaaagtagaaagtcacaactcaggaaagttccacttcaactctggcacgatgcttcacaaatgatcttgatacaccttgcaaaaatgtgtcctcaaaccaacttccattattgaccatgaatattttccagcactcaatcccaaccttccacattctcactgcttccctccctcctgacttccctttcaaattttctcttccctctctcctatccatttccttagccctctcctccttaatcatttccacagctctaattaaactctgaatttccagacatatttatttccattttaactcccagaagtgctatatttctagccattagacaattctatctgaaattaattaccaaaaaccagctataatcctcttccttaaactttctcccagtattttccccagtattatcagactaaaataggagtcctcaatttcttgataatttctatggaattcacacttcctttccctttgttgcctatgttctgctttagtaagagctctgtcacttaacactgtattactgcagtagtctcttaatgagattcccttttccaggctcttctccataagagtctattccaacaaaacttgaaaaaatccagttgctgcgtgtcatttccttacttcagcatctacagttctgttaagtggatcaagcaaacatacgaggtcgactttcaagaagccgcagtgtattcacaggccacctgtccgctgtttacatccagattctatccaccacagattcccagttcctccagtcagcatatcttcattcacttctcttgttactacttttttttctcacattgttttcccattctgaaatgtcccatttccttcatttcccaatcctgtattccttcaaacacatttttccatgaatttttccaaacccagggaggtggaagtggagttaaaggagccttataatcaagaaaacaatgacggcaggtagaagcatagtctatgtaaaggaatggagagtgctaataatggttaatgtgtagcattttcaaccactttaaaatataattatctaaagcaaaatctaattaccattaccatgtattgtggtgtttattaacatatgtgaaagtaaactgtaagaaaataatagcctaaagaatagatggaggaaacagaaatatgctgttgtatgagaattggttatgactcaaggtagactaagttaaacatgtgtactgcaaactctagaaacaacctccaaacaataaaacagacatacaagaagacaatagcagtgataaaatggaaccataaaatattcaacaaatccaaaagaaggcagacaaagagaaaaaaaggaacaaagaaaaaaaaaacaaacagcaagattgtatatttaaacccaagtatgtcattaagtacattaaatgaaaacgggctacccattacattaagtcgtattttctaatgaataacagaaaaacaagaattgactatatgctgtctaaaagaatatccacttaaatataattggcataggttaaaggtataatgatgggaaaagatatattacacaaaagcaaaagaaaggtggagtacttatattaatatcagatgaagtagatgtcaaaacaaatattgctgccatctatacagaagaacatttcctaatgataaggaggtaaagatgagcgcagtgatgtatgcttgcaatcccagctactcaaaagcctgaggcaagaggattgcttgagcccaggagttcaaatccagcctgcacaaaatagcaagaccccatctcttaaaaaaaaaaagaaaaagaaaaaaagatgaggtaaattcaccaagaaaacaatccttaatctaaatatgtatgcaactaacaatgaggcttcaaaacacatgaggcaaaacctaaaagataaagtccacgatcatagttgacgacatcaactatctttttcagaaaccaatagaacaagtaggcagaaaatcagtaagaatatagaagacataaacaatactaccagctgtcttgacctaatgaacactggtagaacaatttatgcaataaaagcagaatacagttgacccttgaacaacatgagattgaattgcatgggcccacgtacacccggattttcttctgcatctgccacctcttgagacagccaagtccaatccctcctcttcctcctcctcctcagcctacttaacatgaagacaacgaggaggaagacctttacgataatccacttccacttcatgaatagtaaatatatttcctcttccttatgattttattaataatatttcccttcctgtagcttactatattataaaaatacagtatataatacaaataacatacaaaatatgtgttaatcaactgttcattaaggcttcgtcaacagtgggctactagtagttaagtttctaggaagtcaaaagttactgggtttttgagcatggtgcccgtaactcccacattgttcaagggtcaatgtatagattctttcaagtgtatatagaacatacagcaacataagccattttctgggccataaaacaaatcttttaaagtgtaaaacaattaaaatcatataaaatatgttctccaaccaaaagagaattaagctaggaatcagtaacagaaagatatctgaaaaatccatatatttggaaattaatcaacacacttacaaataacccttaagaaggaatcacaaggggaattaaaactcttttgaaatgaaaacacagcacatcaaaatgtgcaaagcatgactaacagtccttagagagaaacttaacttagatgataaattccttgaaagacacaaagagcaaaattcatctgagtaacaacagataaccacaacagccctgtaactattaaataaattgaattcacagtgaaaaacttaccaacaaagacaaaactccaggtctagggagagcttcactagtaaatcccaccaaatatttcattaataaataatacaaatcccatacaaacaattcaataaaattaaagagaaaggaggagtacttccccttttgtttttaaaaagcaaacatgatcctgaagtgaaaattatacaaagacattttaggaaaagaagatgacatagtaatatcactcaggatttcaggatgcaaatatccttagaaatacaatgtaccaacgctagcaatatataataacacatcatgaacaagtggtttttttcaacaggaatgcaaggttcactcaactttggaaaatcaatgttaattcaccattttaacagaacataaaagagaaaagccatatgatcattgcagtaagtgcagaaaaagctttaataaaattcaatacccattcatgattttaaaaactctcagtaacctaggactagaacttcctcaatctgataaaggaggcataaaacatctatattataacatcatgtttttataacatattcaaataattctggacttagagaagacttacaaaaatatagtacacatagttaccatatgccctttacccaccttcctctgtatcttgtatagccatagtatgaatatcaaaacaaagaaattaacatcagtgcaatactattaactaaactaccaactttatttcaatttcaccagtttttccaccaatgcccctgcctagtccaggacccaacccaggatcccacatcgcagttaagtcatcatgccactttagtctctccaatctatgagtgttccatcatcattctttgcctatcatgaggctaacacttttaaagttatcaggccaggtatttcgaggaatgtccctccctgtgagttcttcaggtttcctcatgattatactgaggttatgcatcttggaggagagcacttcaaaagtactgtgcccttctcagagcatcttatcatgggttccatgaagtcaacatcttacttactggtgatgttaaccgtgatcacttggttaaaactgtgttttccagatctctccactgtaaagttagtcattttacctttgtaaatgataaatgttcacagggagatatcttgagagtatggaaatatcctctttcctaaacttttgcttactaattttaatattcataggtgaattctgaatgagcaattttcactctggagttctaatggtgatttgattttctactctactcacctcttttacattaattggaattcatctgtaaggaagacatgtccctctcaacactttatttagacaatcaatcacttatttatgcaatatagactcatgattacatatttcatcctttggatcataaactaacactatatttactttattactgaaattgtttcagcttctgctacaggacccttcagcttgggctgttttctaggtcttgccttttttttttaaggctccctccttactttctgacaccacaaaattctccacgctcatctttttttctccccctatactagtgctgaaatcagtcgcgtcctcaaggagccttggttccttttattggagaataatagttagaaacccagatctggctgctagatgtgctcattaacatcatatttaatggtaaaaggtgcttttctccctaagactagaaacaaagtcaggatgctcactcttaccactattcaacattataatgaaggtcttagccaatacagcaaggcaaaagaagaaaggaaatgcatacagattagaaatgaagtaaaactttatttacagaagatatgattgtctgtgcagagaattgtaagtaatctacaaaaaaggttactacaactaattcttgcaagcctgcaggagaaaaggtcaatatgaaaaaaccaactgtatttctatatactggcagtaaaacaaagtgaaaatgaaattttaaatatcatttcccttggaagacatgaaacacacgtaaggataaacctaacaaaatttgtgtaagacttaaacattgaaaattacaaaacattactgtgagaaattaaagaccacctaaataaatggagaaataaattgcattcatggatctgaagactcattgttaagatgtcagctcttcctaaatttatctacagattcaacacaatctcacacaaaatcttagcagactgacagagtgtaaaatttacgtagaaatctatatagacattaatctagataaattcatgctataaaacaccctgctagagaatcttaaaagcttgaaggtagttaaaggatcatatcttttgcatgagtaaatgacctgtccatttccacaaagaaagcaagaagcaaatccaggaccaggatccaactttgttctttcatgttttgatactgtgctctttagagtggtacatcatgctacttgtaattaagattactttcactttttactttgcctagaaagagattcagatctcctcaacagatgccagaatctctagatgtgccatcacctctcgatgtgcagcaataagtagaaaaataaccaataattatgtgataataaattaagaataaatttatcaaaacaataaaaatgtaacaataatccctgatcttaggaatgaattgacttttacaataaattacacattttaaagatataaggactccattaaaatgttttattttataaattatttagtaatttacactaaaacactgaaattttaactgaattcattaaaacagctactaacccccaggctggttctcaaaattaatttcatgttcatctgtgatatgatacaaacccaaatagactcaatcacattttccttttagaaagaaactcaaatttaaaagtgctgctataataaagttgctccttcaagtatatatggggcggcagagaacaccagagcctcgcgggtcacacaggacaccgtgagtaagcctgtagatggcaccaatccacgaccaatctattgtttacagaaacagtcattttgggttgtgcttctttatgcaagatatttaacacctttgctcaaattaagtggcacccattaaaaaaaaataattataacaacttgaacgaatttatctacatgtcatcagaaggtgtttaggcagctcctcctccctgccagagctgctggctcccctaattccattcccacatggtagctcctggctgtcttactatcacctttacactgggcatgtctaacccagtggagctgagataggacaggccttgcttccttactggtatactggttgggctctcagagctttctccaggtggggccaaactcttattcaacatgaatagctgaacactgagataaggaaacgttgtagcaaatcttatttcctcacaggactaagaaggtccatattttggcccttccttgaatttacagggccacattggtacctcaaccattgtctcttaaagaaatggttcttttcctcttctttttttttggagtaagtcctcctagaagagggtgtctagaaaggatgatatttagttgtagcttattattagctatttattaaaaataaaaccatgcatgatttctgggagagacagcaagcccttcttccttccaggttcttttgtagtgtactgacacgatgaaaacagtacacagctcattagaggcattcctatatatgcatgcaactcataaggaacatcctcagtgatactaagtggatataaaattgtctgtaagaagtgaataaacatttaggaatgctcaagtgcttctcataaaggttgtgaaggattcagtacttaacatggtactttatacatagtagaaactcaagatatgtgagttgaatcgagtagaggtgtctaatatgatgcacctattttaaattcctagttacaagaaacagaaaatcaccatactcccagtaaccaataacataatacagacatgaagtgcttgtgttacttcctcctaactcatctaattcatatgacataattctatgtttaccttaaggcttaacagagaagaacacttggcacataacagaccccaaataaatgttgttgactaataaatgtttcagagaaaaatatgaaatgttggaataaactgaaatggatgaactaaaaataattacagaaaaattcggagtagattattgaatgaaaaacatttcatagtaaacattttatacaagcatctgaaaatcaaagtatcaaaatccctgtctgtactaacaatatctgaggtagtgggggaaaaaaaaaaaaaaaaaaagcagggggagggggggacagacataataatttcctgctcctgaacttaagcaaaaattgcagtactaagaacaagaagggtgggtgcagtggttcacgtctgtaatccagcactttgggaggccaaggagagaggattgtttgagcccaggaattcagtaccatactgggaaacatggcaaaacctacaaaaagtaccaaaaacgtaggcaggtatggtggctcatgcctgcagtccgagctacttggtaggctgaggtgagaggatacttgagcctggggaggtagaggctgctgagctgtgatcgtgccgtgccactgcactccagcctggccaacagagaccttgcctcaaaaaataaataaataaatgaataaaaagtaataagcagatcacaataaaactaaacatatgtaattagtagtggttttttgttttttgttttttttttttttaagagattgggtctcactctgtcatccaggctggagtacagtggtgtaatcacagctcactgcagcctcaacctcctgtgctcaagcaattctcctgcctgccttagcagccttcttaggagtgcgccaccacgcccagttgattttttttttttcttgtagagatggggtctcactgtgttgcccatgctggtctcaaaactcctggcctcaagtgatcctcccacctcagcctcccaaagtgctgggattacaggcatgagccaccatgcctggcctagtagtattaattttgtgggcaataaagttctgtttcaaatgacagagaagtccaaagtaagacactgtgtttactaccttcattaaatattaaaaacaaatttctttaaatttcttttaaaacaaggatttgtataaatgaatctgaagtgttcactttaaaattaaagacataagggcaaattaaaaaattttaactagttttcttaaagaaaaattaacacttggtatctttattaaaattaaagaaataatgagaggcaaacaaattattatgggaaaaaaatagaaaaattctgtgatcatgttgagcaaaatctcaagaggcatttggggagtcaaaatcatgagtaaaattttgtgcacagaagttcaataatcacttaaatgtcggtaaaatggaaagtatcattacatcattaacttttattcacttaaaatatttttgctataaattcattttagcagtgcagccaaaatatatacacactatgccataaagaaatcttacctttttatcatatacatcttgccagtttactccagagaagaaactgtgtctcataatttcttttgcatcatctggtcctccaccaaggctatgagaacagaaataaaattaagtaagtataaaacatttacataagctcaaagcataacaaaaaatattttgtgaaagtgtaattttctgtgtaataaacagttcttgggataaatagctctaaaagtaaaaagcttttgctataagatctatttttcctaatatgcttgtaagaactagcttcagaacagtatggtatttggaaaagagcagaggctttagagatagatctggaagaggcaatcatgtctggcacttatgagatgtgtgacaacagaaaagaggcttaacctcagttttctcatctgcagagtggggaatgataacgtttgctggtgggtcactgcaagggttagaaacaacataggaatatggtttggctgtgtctccacccaaatctcatcttgaactgtagctcccataatccccatgtgtcatgggaggtaccaggtgggaggtaactgaatcatgggggcaggtttttcccatgctgttctcatgatagtcaataagtctcatgagatctgatggttttataaagggcgattcccctgcacatgcccttgcctgctgccctgtaagatgtgcctctgctcctccttcaccttctgccatgattgtgaggcctccccagccatgtggaactgtaagtccaataaacccctttttctttataaattatgcggtctcaggtatttcttcatagcagaatgaaaatggactaataataggtaaagaaatttcagtgttttctggcttattcagtttaatatagtatatattactaagcataaaagaactaaaagtgagaaataggaagaacaggaggaaaagaggggaaaagaacaaggaaaggaagataaaataaacctatttaaatctgaattttatatagtaggctttatttggacttgttcattattagaaatgatatgtgctggtaagtgcttaacaaccagctctctgtgagcaatcatgcatttatacaaatataattttttttcttttttttttcaaaggcacagtagataccagatgctcagagcagagcagccatggagctgctgggaccaaaccttgcctgacctagccaccaccacaccccagacatataaatttaaattttactgatataaagaatgcaaaacacaaaatttacaaagatcataaaacatacaatgttgtgtattgtaaattagtcacctgattctcacagaaaacttgttaatttctgctgtacgccaaagccactaatggatgaaacttacgattagttccaacatgaatattggttgacatttttgtttatgttaaagtcaaagctgaaagtgatacaatggagacttcagaacttcacttgtcagttatgtgagtgatttctttgctaaatgtttagtaactttgggatggtggaagaagattcattttttggtgctatttacaatgtaatgaatctgcattattaatattttctcttaagtctaaacagtcaacaaaacagtaagtgcagccccaactcatagtatttgccaattctggcggtataaattcttccactgtggccagtttcgagctaccaataagatgtcactgaacatgtaggcaggaagagatgcatagtagcaaaccattatatattatgtccaaacagatacagcagacataactaatctcaaaaatacagataacagtgaaacataacaaattaaggagtaatgactttttagtatttatgacctttgattttcctattattagtaaatttatataatttttagtaatgactataatatacaaccagctcataaaattggtgaaaatttaacagttggttcttgagagctggtatatgctaactccaaaacaccactgggttggaagaaaaccaaatacgtcatagaaaacaaatacagatgctcctaaacttaatgatgggttatgtctagataagcccacatttcaacttaagatggttttatctggatgcaattccatcattagttgaggagcatactaaatacgcatcagtttcgcaccatcataaagtcaaaaaattgtcaagccatcgtaggtcagaaatcatttataattatataattctaatgaattctggttattagatctaagaaacacatgactgggaaggacctagtatcctttgacacacaattaaaatggaaaacagtcaactgatacctgaatatctttagtgatgataaataattcccaccagctgggtctccaactcccagatccttatagaattctctaaatgaactataccccagagatggcacttttaggtttgatcataatagtgctgttcgatgtttgcatttggaattttcagactggtagttctgtgttcagtgagagctcagcatttcagaccctgccctctttttcattctatttcagttgtgtaggtttctttcccaggagactgcaaactcctttgaaggcaagatcagtgctggattatccaaaaggcattctaagcttgtgcttggggaaccagagaagcaaaagcaccaaaacacgtttctgaaaagcatttaatattttcaagcatgcgtcaacatagtctgcatgagaaacatcaaagctccatggcattttcttacacttatgttgtagtttatttcaatactgttttcatttgaattgtacttgagatgggagttggagtggagaatcataatcattttgtaaataaaatgttttaatccagctttagttatccatttttgtaactcctcaagttttctagcaatactttggttttgaacatagccagcatttattctatatttatcaaatacatataaaactaaaatatcagctatgaatactatgcaaagtctgagaatacaatcagacttccattttagaagctaggagaaattctttaacacacttcttcaatgtgtgaaactgtcaaaaatttcagtgtcaatgactctctaatatacaatttaagacttcaaaaataataacaaaatatgctttgaagtaagatatttatgtctagaatactaaactccagtatcagaatgccagactaaatcctcagctactacaaattcctttactattaggaacatcacagaattcacattttcctaatgttactgaatacatgaggtcatgcttttcctatcaactccgcataggaagataaaggaggggctaacagaatgaacagaaaggatggagactaagaaataaaagcaaaatgatagttgacccttggatagaactaacagcaattcaataagaaataccagaaaaattccagtagtatttaaaatagctgcgtagaaaaaatgaagaggtgtattataatgctatcattacttatgtttccaaaggcttttcaaggtccttgttagctttcttttctttctccccctgaaactgaggttccctaagattctgtcctaggccctcttctccttatccactacccttgccactactgccttggctctagctacctcctagatatagttatggttcccaatccatgtagtcagttactgtgtttcttttaagcattcattctattatttccagctgctcacttgacatttccatcttggttttatatagaaacttcagactcagtgtacccaaagttattatcaacatctagccccatcaagcctccttggtttgcataccctgtctgttaatcaccctagctggaaacctcagagggattcctaactcctcctacttcctcatagtttctagttaatcataacctctatcacttgtgtactactgcttcaggaaggaatccatctattatctgaacaattccataaatattctttttaaaaaaaagacagggactcactctattgcccaggctggagtgcaatggtgtcaccttgggtcactgcagtctcgacctcctgggctccagcgattctcccacctcagcctcccaagtagctgggactacagcatgtgccaccatacccagcattttatttttttttagtagagatgaatcttgctatgtgcccaggttggtcttgaactcccgacctcaagtgaccttcttgcctcggcctcccaaagtgcggggattacaggtgtgagccactgtgcctggccccataaacacttttaactgctctgcctgcccctggatcctcactcatctaatctgtccatgacaaagctgccagagttaccttttcatgacacaaatctgattatactatcccttgctttaaacacttaagcagtatctcaccctcttctgaatgaagattaaatattttctaagaaacctaagatccttataatctaatatatcagcttcatttcccagtgttacccaactcatattctacactctagtcactgaacttctcaaatgccatgttcttttgcaatcctagctatactctacatgtaaatttctgtgcttgagtgccaatgcaaattcaaactcctttctgatccagctcaagtcccccaatcccctagacaaagccaataatttcaacagtactttgtatgtagtttgacctgagcatctgtgagtatatgttttgtgccccaaattattctatgaacatctagagcagagactggttcatctcactcatccttgtattctctgtattttgatgcagcagtggaggggcttgacacatctattataaaagaaattattagatcattgaaaatactgcatcttctcattagatcaatatcaacctcctggtgaacaaacagttaggaattgttctattaatacatactaggcggttaacattctaagaatttgcctcacattcattcaatagttcctaagtaccgactatgtgctattcatggagtgggctgacaaataaaaaaaaatgaatgagacatacacatgaaaaccacaagtacattttgttctactagccacttatataaagagggccacaaagtaaagggtggtcaaagttgcctgcaggaataagaaaacgatgagataaatattcactgcctcgaataccaagccaaatattagaccaaaaaatgaaatagataaaagtcggctggacacggtggctcatgcctgtaatcccagcactttggaaagccgaggggggtggatcacgaggtcaggagatggagaccatcctggccaacatggtgaaaccccatctctactaaaataccaaaaaaaaaaaaaaaaaaaaaaagccaggtgtggtggcaggcgcctgtagtcccagctactcaggaggctgaggcaggggaattgcttgaacccaggaggcggaggttgcagtgggccgagattgcgccactgcactccagcccagacaacagagcgagactccctctcaaaaaaaaaaaaaaaaaaaaaaaaaaaagataaaagtcaccactctgtttaaagttacctatcatcgggtgctgctccttacttaattgtaaaagaacgctatcaaacggaacacatttcaaaacttaaactgagaaactgctgcattgtaaataagatacataagaaataccaaataggcaccaagaaacttgacttctactcttggtctgcatgaatgttctgagagaccttgaagaaatcacctaaccctctctgggcctttgttttcaactcaatgaaatggaaataagaatagtatctcccctatccacccaacaaggctcctgaaaaagcaagggaattaatagctgtgaaagtgctctgaagaagaaaacaaaatcactttacacatataaataatatctgcagctaggattacaaaatgtttcttgaatgagtcttcacaaagcagaaagacaatatctcttttattatgtttgcttatttctgctgaagataaagccatgttccttacaaggttaaaagctagaagaatacaatgaaaaccatttctcagatagacttaaaaatccaactttttgggattcactcattaacccactcatatatatataatatatatatatatgagcatcaaccatacgtaaaacattttcataaaactctatgtgaggtattataaaatattcaacaatatgtgaaatcatctatgcttcaaatgagtagactcagagaaatactgatatgcacagatacctagatgggaaggcagatatatccatatacaaacacacatattaagaaacattttaatattaatagtcatttcacatatgatttatgaatttataaatatgaatgaatgtataaacatgaataaaaatactgtagctcattgaacaaagcagcaagagccatagagttcttcaattcatagctgtagctacaaaaacagaaattaaaagtgtgtacaattattttttgccatcaactctttcagctatgcatagaaaagattattttcaaatgacaaaaaagcagttagaggccgggtgcggtggctcacgactgtaatcccagcactttgggaggccgaagcaggcggatcacttgaggtcgggagttcaagactagcctggccaacttggcaaaaccccgtctctactaaaaacacaaaaattagacaggcgtggtggaggtgcctgtagtcccagccactcgggaggctgaggcaggaaaatcacctgaacctgggaagcagaggttgcagtgagtcaagatcgcgccactgcactccagcctgggtggcagagtgagactctgtctcaaaaaaaaaaaaaaaaaaaaaaaaaaatgcaattagatatgttaacacaggttgcgggtgggaggagagtattgaaaaataggtctattccttttataagaaatacaaaggcccagagactgaaagaaagaaaagtgattcttctatccccacaagatcaagtaacagagcaattaagaaattttcactcataatatggataatgaaactctcaaaatccttatttggtaaatctgcataaaatttccaagttaggaaagagttgagaaaaatttttaaatgttctatattatgcagttaaaaataagtcaggatctcagtgggaagatgtctacaccaaatacattgcttcttggagttagttatatttgaattaatttccatatctcaatttttaaccacattcatcagtaattcactaagcgttatttgaggcttaccgtttatttggatcctttatcaagagccctgaaagcaatgattttgcatctgaagagagtgttcgaggaaatttaatgtcttccattaatattaattcaaaaagtttctcatggtcctggttgtagaaaggtaacctcccacacatcatttcatacatgacaacccctaggccccaccagtctactgctcggccatagtcattatcttctaacacctaaaagtgaaatcagtaaaaagattaattattacatgttaacttttaaagcattattcataaaacataagatttttacataaaaatgaatcttaactttcaaagcctaggtagtctgagatcttgacatttaaactgtgaagcatcctacaaaaaatacaaatcacatcaaatatgtgaaatattcaatatatatccacaaatggccagtgtacaaaaaaaggggcaggtcgtacaaaaaaaaaaaaatcccaagtacatgaatatacataaggatcaaatgaaaaacgttagctagcatatttacatattttttcttaggcctactgactttttcattctggttccacccatgtggacttcaagtaacaactcagagctagggtgtgctgattatagagcacataaagtgcactgtacattcttgccttaagaagaactaagtaatacaaattaaacagtgaaagacagtagtaaacaaaggcaatgtaatggagaagtctacagggcaagacaaccattaaaataactttgaaaaacctttggatgcccctgtatgtttcaactctttctggaactatttaagagacaaagtgaatataaaagcttatggtacgagctgtaataaactttgatagccacagctttatacctcacaacaaaaattcctgttacagcaaaaaaaatggacttaatatctgtgtggtatatgtccttaaatttttcccaaaatatattacacgtaaaataaatttagttagaaatgatacaaaagtatccgtttgcctatgctggagcaacctgttcaaatggtaacatggtaacctaccatttgccccaggaaaaatttggttttatctttttatcagatttgttcttcatccaatggaatattcctcatctatatgcaactttgaatattttattttaaaactatatttgataatcttaaagcttattttatttgatcctctcagctttggaaaaccagatggggaaaaccaaatatatgaatttatcaatttaaaaacacttacaaccgattacaaaggagaacatttgataaggacaaagcagtacttgtgttccaaactttcttgcttcgaattaaatattttctggaagattactcctacatgacttttatttaaaatttaccaataatctcacagaattacaggtgatatttttgacagttacattatgattacctaaaaatactatgaaaggcactttggtagggtatttaaagacaaaggatataatttataagaaaaaatatgttacttaaaagatctattcaataagcatttctattatgaaaagatttttaattcaattatatcaatgtttgttttacggctaaaaaactgaaaacttcactggtaagatatgaacacatgtttagatcctatgcttttctagaaatgttttgtaaatcacaaactaacaaaaaaacattttctggaagaacaacaaattctagttttcatcatcagcgcaaagaatgtcatatttttacttgtttgaaatgagtaatttgagaacaaatagaaaacaaaaaataacctaaaaaagcagaagaaattctacttcatatttacgttaaaggaaatgctgcatgtattattttaaaataccactgacttttgatgattcaaggatctcgctcatggccaattagtacaatgcactgttggtgggcctttatctaattgacacaagattttaactaataacaaccaaaaatttatatctaagtaacctttaactacattcctacaacaccaacacaacagtggcatatacgaaaaggagccaaatgtggtttttaacctcttttttttttcataaaaccataaaaagcataaaagctggattaactgcctcccgaacccacatttcaccagccgggttctcatccccagctggcaaaactggcaatcctttattttttttaaatacctggtttgcagccagaagggaaagtgagtacataaaaaaggggggttttatttttgaagagaagtaagcaactgaaaaataaaactgcattgtaaaaaaatctgtttgataaaataaaatacattttatttagctttgtaaaatgaatatcgattcttaaaataagtgattttgcctctgaacatacgtgccttaattgatctacagatacataatgctataattagaactgtttgccgtattactttgtattgaacaaaactgatgtaacgtattgtcttcctgacatgtaaacttaagcaatgctgagaagaaaacaccctaacaactaaaatccctctttacctaagagacttcactatcaattagaaagatttttgtccaaatcctatctccaaacagctataagatgaaacatacataaataatgattacagtatcctacatgtggatacatatgttcccactattaaaacaatatcctttctctttcctgaatctaaattatttcaaaacacaatactttcaaatactctggaaatcccacagccaaattaaccaattcgaatccaataacctctttcacattattttaagaagacaatttttctccctctactcaaagcacttattattctataaatacataacatataaaatttacatttttttaacttaaggattgcaaattctttctggctacctctgatcatttttttctagctaaaaggctaatttatttcatggttattgtgagggctggctgaaaggtatgataaacagtggtataatggacaggtacaacaatggtagagcatatttcaacttcattaaaaggttaatttctcatataatttggatataaatgcagatcaaaatatgctcctgaaaaaatccagtgaaagatttatcttgaagaaataacttctgtctcctttccataaaaccaacattactgacttgtaaatgaaacccaaactttaaataggaaagcagacatttggtatttcctctacccctacagtcctttgtaaccacagatgtagttgtacattatacctacctttaacacaaatgcccaaacagagatgaaagaggagatttggaacatcaaaaaaatgtaattgttaaaaaatgatgagaggtcacatcaaatgaaaacttaaacagagcacaaagtctagaaaacaaggctgtatttctaataggagccagaaactgctttactttatgatacgataaaacctaagactcaaggaggttacagcagatacaaattaacattaaatatcctggaaatatttgatcaatatttgatgaagacacttacatttataaaacagccaggtgagttaaaacacattagtttttgaattgttattaatttcaaagaatgatattgaatgagaaactatatatttttaaatgatactaccaattcaagttactaatgtaaatatttatttggctaatgggctttttcaaaacaaaaaaaaaactattcattacaatatttgtttaccaggaggatttactaggaggttaaagggacccctctctcagcttgcccaccaggccacacaatgcacccaaggcaagcaattataaggaggctatgtatgccctggagtggcttactgctcaatcaataatcctgacagaacagatgggggaaaaaattaaacatctaaacaaactgtctgcacacctatgctgtgaaagtaaactgcgaacttggatgaaccaatttaccactaattcaaaaaaaaagttttttctggtagccttacatttcaggtaactgatagatgtgtgttttatacctaaacatacatctgtatcatttatcatttatgggagcccttcagatattcttaacatcacaggtatgggctaagaaaaaaagacctataaatcttctcattcagattttaaagtaaactgcagcttcaggaaaagtatccatttcaatacataagattataaattctacagttgcttggtattttcttcataaatatatattttataactatttctcaactgctttaatagttcttaagtgacagcaactgtcaatgccatttgctatgaattagaatgctgtacgctttatggccacctctcctagcacacacaaatacttgtatacagttaacatcgtactttcaaaagcaaactctggctagcacaggaaaaatcctttgacaagagaaaggctaaatggatacaataatgatgattagatcatacttacacatatcttccaagaaatttctatacttcttttttattctgaagcaatagacattatgggattccaagaaactgagccttcataacccaagtaacaatagccattgtaaaatactataggtaatcaccagtgtttccagttagggttagttttgtatatgttctcatggtacagagaatttaaaattaaacttcatgcttaaactagaatcacaccgaagtactgaatgcaaatattctgttaaagccaaaagaccatataacattgaaaagaagttagggcgaaaaatagctactttaagaactgacagacctctaagtaagtaaaagatgccacttataaacattgagaggcgttaattccattttagttcatatttaaacaatgtccaattatgagataaaatggaatggcttttaatattacccagaaaatcatataaaatagcaacatactatagaaagaaattaaatatattcaactaaatagtaagccaactcatatgagagttagaagttcttaaacatgaattctaactatagagcagacagcttctatctgaactcatccctctactcctttaatgttccctttaatcatggtgatgagaccttttctgaattcccaggaagatgaaggttttcaaaattaccccaggtggagagatatcatatgaattatcaataagtaaataaaatgttagggttgtccacaattttagaaaggctactaaaacaactctttcttttcacaaaaagcatagagattctaagactagttttacaatctgctggaatatagtaggactttgtgcaaagactaatcagaatgtaactacatgtgctactatttttacctacagattaaatgtgcaaacatatgtaactttagcctcattcatttctcttcagatctcctaaaaacaacattggcagcacccacaaaatgacatattttacatttattctttgttggatttaaaataaagaaaattctgtttaatacatttcaagcaagttagcttctaactatttcccacacctacaacactagtccatgccctggcactgcctttactaccttttgtggaagttaatatatatctttggtttttaatttatatagaaattaatctccatgtgtactatgagctaacacaatgactttgagcaaatctttgtatcaaaatagttgtcaaaatattctcatctatttcagctattttaaaaatgttacattatatgcaagatattaaagatagtaggtttcaaagaaaaaatcaggaaaattttggcaagcaaaacattttctaagaatggggttctaaaaaactaaaaagaatgcatcaaatactgcacttcagccactggaaaaacaaatcattttacatttagatgaaataaaattagatgcatttttttctcaatagcaaccacagctagatatatttcccaacaatcaagtcattttttgcaatctttgttagttctaacttgattatcaaataatttttatttttacactattacagaagtgcatttctctaggtttccaaaaccaccttattcaaccttccccatctgtcaccatctgcctctttttagcatgtactttttgtgtgatcacataagcatgtgaaaaataactaacattcagatgattatctgctggtacatttgaggactgggcataataaaagtgaactgccaaaacgcacttaacacttttaattttgttgggtcttgcatgtaagctacatttgattttcaaactgttttacagttggaaagtggatcaggtactgctaactcaagagcaaagctgagactctaaataattagcactgcataaaatggtttggattcaataggagccaaatcaaataataaaatttagcagtaagagtttatatgtgatttctaatttcttttataatttctaggtgtgaaaatacagcacagattataaaaacaaaatcccctcaagatatcatatggtccataatttactataagtttatttccttcgaatgtacaaaagagcaaaagtacattcatttaaaactatacatacaaatgcagttttcaagatgtagcacactaaatgcacagtgcatatgccagctagaactgaaccgctgtaacctgttaaaaacacaaaacaaaacaaagctagccttttctacattagcagtattgttaaatgcttcccaagttggaaaactgcattgtaagctgcattcttcatcaaaagagataagagaacaaataccttaaaaatattcttttttcaacaaatggcatatttatactgtaagttttatgtttttctaatttgccataagaaacaaattaagttcacttaaaactcaagtttattttaaaacctgccatgtatctgacattggacatttaataaactggctttaaactgatttctaacactctttgtgaagtatcttcaaaatacccttcacctgtctttataccagattaaaacaacgtaaaaggcgaaggaacactattgctagatgaagtataggttgcagcaagattcctacataatgtgtaaacaaatcttctgtaaagacagaggggaaaatgttgacagtgagtcattcacaagagaagcagtagtcaagaatgtattacagatctgatacacaactactacttctagtactgtcacgaaaagcccagcattaataatggtaatgtactagaaatttcaaggtccaaaaaaagtgcgagacaccatctgaggtaaaaggaagaggctggcttcagctcctgccaatcgctccctaacactgaccatgtaaatctgatcacagtatcgccttgctctcaattcacaagtaattttccctagcccacaggatcaaatctaaaactgttacatttcaatccctatctatgtgtccagcctcctctcttcctgcttccccttttccactgccggaccctccctgcaggcttaagcacttttccttttccttccactccactgtatggaactagtaaagcagttattttcttgcacagtaataactgttttccatgtcttatcacctcagtgaacagcaagccacttgagggcaaaaacatcttctaccatcgttgtattcccagtacctaatgtaatgcctgatacttaatattcaataaataattctttgatgaatgaatgagtgtccctcagtaaaatggtccacgctgaagaccagaataaaggaattaaattcttatttttttaagggtaaacacagtcaaagtttaaaaatgcaatatgtgacacaacatttaaaatataaaagttacaatttcgtaagttgtttcaagatttctcatactcaaataataacaacaataatcactcttccctataaaaacatggtgtccagatttgaattatgaatcaatgtgtatccaccaaggatgggtatacaaactgtttttaaagaccagacttttgaagtattaaaaaaggtatacagaaatgttttcttgtctttaaagagaaactgataattttgtggcaactataaactttccattcagaaacaagtggactcttcttgcattagattcttaatttgttcttcagttgatgacactgcatatgaaataatatatttgtttctcagatcatctgcttcttaaatgagatgtattcatcttcttcagaaataatttaccctaattgtgacacaattaattttgttattctaaatatggcatatcttcttccatagcaaatttatagcaggggtaactgaactccagagaaacaaataattttttgtgacatttataaaaacaattctattctagaaaatattttatttgaataaacaagaaacagtgttactaaagttttacctaattaaaccacaaaaatagagaattctaaactacaaatttttaaagagagaaaattatatttttggcaagaaaataatagtatgaaatttattgtattttaaatagtagcacttatttacaataacttaacattgttgaaatgtaaatgtaatccctagttgaaaagaagtattagaataatagaccagcatgagttactttatgtttaaggaatgctagtatcattggggatttattttacttcctaatttcttttgattaccttttcctgttgggcatttacaaagcattcatttaaaaattacgattatttatatttgtaagtggtcttcaaattaggattttttgaggccaggacgtatgtagtttaaaaagtaaaagtgggctttatagtcagacacactaattagaatcttcattacacttctaccacctcttagctgtgtacagataacatttaaatattctgatcttatgatccctcacctttaaaaaattgcatttgctatctatcatcaaagattattccaaatgttaaatgaaataatagctgtaatgcacttacacagcaggtggcacatagtagatgctcattaaatagttaccctcacacatcaaatattaacacctccctatttgcctatagccacaataactgtattggagtttgaggggaaatggagcaccagctgctctctttggaaagctcttcccttttacctttgcaacaggtaccatcactttccatcaaccatcactttcgctgaacatagtatctgtgaaagatgttatttttcaaagatggctgtggcagtatctcccatctcacatgctcttctgtaatgtaaaggtgtggtctctgtctctaccactttaacctgtgcaggcttacaactgcttcagggagtaagggtatgacagaaatgatgttgtgtgacttctgaaaataggccataaaaggagatgcataaacaaatgttcatagcagcagcattattcatagtagccaaaaaatggatgcaacccaatgtacatcagctgctgaacaaataaacaaaatgtggtatatccatataatggaatattatccagccataaaaaggaatgaaataagtataacatgctaaaacagggaggaacactgaattttatgctaagtgaaagaagccagtcacagaagactccatactgtatgattccatttgtatgaactgtctacaataggtaaatctataaagacaaaaagcagatcagtggttgcctgtggcggaaggaagaatgaggagctaacgggtatggggtttcttgctggagtgatgaaaatattctggaattggacagcgatgatagttgtacaactctgtgaacatattaaaaatcaccaaagtgtgtattttaaaagagtaagttttatggcatatgaattgtactccaattataaaaatatctgtgaaatcaagtttttaaaaagttaatagtcttgatggtttactaggtggaaacaaaggcaccatgcagcttctaatgtgttccctaggacatttgcttttagggctcagagccaaagaagtctgactgcattgaaactgtcattatgaggaagtccagactcatggagagaagggctacatgtaagtgttcctgccaacagcccaaataaggtaccagtggacaggcagcagaactgtcggacatgtgagtgaagatgcttcctgatgactctagtctccagccatagaatcatgctctcactgtaaagtctttcaagctgagacctcatacatagtggagaataaactagctatccttgctgtgcccatttgcattcctgattcagaaaatccattattttatataaaatggttgttttccactgctaagtattagggtggtttgttacacagcattagtaactggaacaccatctacaacagccacaccacacccttacatttaatcttgcttttttgtttgtttgtttatgaaacttaagacattatgttatttatttatttttattctgtctccctccactgaaagttaagttccctgagactaggatccttttctgtgttgtgcctgtaaccacatcatccagaaaagtacctgatatacagcagatacacaataaatatttgttgaataaacaaattaataaattattgtggaacccttagcacagggaagttaccagtttggagcttcctctgacataaattccaaaatgtagctactgtcatttcaataattttcccaataaaataattttaaataaacccacaatactataaattaaaaaccactgttgtttctaaggaaagtccaagatggtttataaatataaatactcttgctgaaatcaattattctattttaataaatgaatcaaaatgggtatagccaagataaaatggatatggccaagaaataaaaattgatttaactgactatagctagtacctttgtgcttatagtttataaaatttaatttcagtatattcttgatcctacaataccccattataacaaattaagagccaaaaaattttgattcaggttgaaatatagataaaagtagtagatactacagttaacttttaatgcttaaatggtttactttgcaaatcattatgtcaatgttactttcctattaatggaaccgaagcctacctctggtgccagatattctggagtgccacagaatgtcttcatggtggctgcatctgtgatcccttctttgcaaagtccaaaatctgtaatttttatgtggccatctttgtccagcattagattctccaactgtgtattaagaaaaatgacataatttgttctatagtcttcaacaacatgaaaataccattttaaaaaactactgaatgctgagtaaggtattttggaaacaggacatagttgtagctaatagaacgctcagtacttacaaactctgttgcttcacgtgtaaaaagaaacatgttttatcaaatacttcacgatgataaaattatctatttttaaaccgatgggaataagtgatatagctttaagagccattattttgtaagttctgaaattaaagcctaatcaacttttcaaagcaaacatcaatcctctttttttaaaaaagaaaatgtgatctaaacaatcccaaagagatgagcatcttcttctagatatatacagatggtttcaacaatttctcctgggaatctattgctattataaaatattcacttacagaaatgttttttggtggtgcttgtaaatcaaacctaaatcttattttgtaaggtaaggcgatatcctcttttgcagttctttgtaataaagaaataccaacccttttaaatataaaaagaaaaagaatatcaaagtcaaacattcaacagttaataaaaatatatagcataaatgttataaagttggaccctctttgaacccattaattcaaaacaccaaagaaaatcttaaagatttaaccaagtaacaggatcatgtgcctcaagcggaaaattatgaaatgtaagagaggaggaatttgtgcaaagccaacacaattagaaataacaatgtaaccagccagttcccctcgagctaatttgaacctaagattatgattatcatcaaacaaagatacagatgagttctgagttatgatcatacagccttatgtattcagggcccataaaactttgcctagtcatgtagacacaacctaaaggtatttcttctgtcatactgaaaaaatatacaaaatgtgaaaagtatattaacaggataaatgatagttaacttttatttgaggagtagattcttattctactccttaatgtgatgacatttgaaagaatgtacctggactctgaagttaatatcaaatttaaaacagatctccactttagaacataaacatatcagtcatataaaatatgttattatactctctgccatattgtcaaatgtcttataaaccagacactaaatacagttaggcaagttgtgttcactgaagcaaagttcagaacagacaaaagtccttttttatagtacttcaatgtgccatctaactaaaccaaatgcttgatatacatttcatgtatagcatgtctcacagaggtaagtctggcttcaatttttttctacagaaagctgaatgaacacataaaatatactgctgaacctttaaaaaaaaatttctgttttgagacagagtctcactctgccacccaaactggagtgcagtggtgcaatcacagctcaccacaacctctgcctcagcagctcaagccacctcagcctcctgaatggctgggaacacgggcacgtgccaccatgcctggctaatttcttaatttttttatagtgacaaggtctcactttgctgcccaagttggtcttgacctgctgggttcaagcaatccacccacctcagcctctcaaagttctgggattacaggcatgagccaccatgccccaccaaattaaaattttttattttatccaaactcagttatcttgtatattcctgtttctctaccagccagaacctagaaaccaaacccaatctgcacaaatgacaataagtcttgtatattgaaaccaatcagaaacatcaagagtcttcaactgtcctattttctctttctgccttggtctgtctcttctcagcctctggtttctctcttttttccacctctttcaaacaacctctcttcttcctccctcccactttgccataatgagaaacgttaagtatatactaaagcttctgttgttttactgaataaaaatgtatatgcccttttattaatttttaaaaatatgctttataaatatataaaatgctgaagatctttagtgaatactcttttactaatataatacattaacaattcttataaaagttccaaataatacaaaatattgaacaaaatgtgaatgtactttttacaccattccattcccatctagtttggtgtgtaatgtgccaatactcctcacatgctttgtatgcatgggaaagtcttcatggaaacatgacagacaggatgcactatttctccacgttttgacaaagctatttttgaagtggctggatacagaaaaaccaaaatgtataaacactgctttttaatacctagctccgtgtgtgtgtacgtgtgtgtaaaattctgacttgcatctaattctgtaacctcgtatctcatctctgagcctcagatcatggttgtgagaagaagaatgaaatgagatgcaaggataggtttgggtaaggaataggctgagggtgaccaactcccagtttgcccagaactgaggggtttcaaagaatgcaggacgtgtagtgctacaactgggcagtcctgggcaaaccaagacagctggttaccctacttgttttataaattagcttttaaaaaaattacaatgatatagtaagaaataagataagcctaagggatgactgagagagatggggtaagggtcatggccatggggactggtagcatactgcctgggaggcagtagagagcaaaatggataagactatgggttcaagtcagagggttcatattaaaatttgagctttatcccttattcactgtgtgaccttgggcatattattaatttctacgtgcttcaatttcatctataaaacaaaagtaaataacagtaacaatccaatgtgacagttttgagaaatgagatgctaaatgcaaacttaacataccataagaattgaataaatgaactcatcttttcttaaaacatgaagagtttaatggcttatttgtaaattgtcatgatgtgggctcttctaaaaaacactgtattttaaagaaaagaacaaagttcaagagtggaaccccataaaacatttctgttggctcaatgactgcattaaaaatacttttcaatatgcaataatttattttaagtaacaaaacacaggctaggcacagtggctcatgcctgtaatcccaacaatttgagaggctgaggcaggcagatcgcttgagctcaggagttcaagaccagcctgggcaacatggtgaaaccctgtctctaccaataatacaaaagattagctgtgcgtggtggtatgcgcttgtggtgccagctactctggaggctgaagcgggagagttacttgagcccgaggtgtgtggggaggttgtaatatgcagagatggtgccactgcactccagcctgggtgacagagtgaaatcctgtctcaaaaaaacaaaacacaaatattttataattttcttatttttgagacagggtctcgctctgttgcctaggctggagtacagtggcacaatcacagctcactgcagcctcaacctcccaggctcaactgatcctcccacctcagcctcctaagtacacaggcgcacaccactaccacgccctgctagtttttgtttgtttcttcctttttttttttttttttttttttaagagatggtattttgccatgttgcccaggctggtcccgaactcctgagttcaaacagtcctcccacctctgcctcccaaagtgctgggattacaagtttgagctactgtgcccagcctcataatttcccagttattttgaagtagtgtccacattcttctatcaattactttgtcttctctcaccatcctaaaacgttgttttgctgagcatgaatgactaaaacttgtccaccaaaatattagcttaaaaaataatatccccaaatctaatcttgtataaagataaatcaggagataataaaatgtacagttctgttatacaatacatgataattttactcaggatgcattaacagagtttctgtaaaatacaaggaccattagtagggtgattcgtaaacctgcagaatgcacagaaacacctgtaagtctttccaaagcatatcaatggcctagatatatcagtaacatctggaaatcactgtcttggttcatttaacactaacataatgtaagtagtatttacattatttacagtagtcatacatttttaggaatctttctactgcgtaaaggaggaagaaaaatatttacaaatgatctttctttagtcttctcttctagatcactttccttcttccctttgttagccagacaatatgtaatgcatattgtcactgactgcttaggtactctaaatttatgaaactttacatgcatctgtttaatattcacagccaatctcagtttccaagatggagagtagggcagcatgcttatgcttaatggatgcatccactaacaaaagtagtgatgaagtcaaatatgaagtcataagaaacaagattgtatattaaaaatctaagtaatgcttactatttctatcagagggttgttatctaaaaggtcatgcttttgaggagagagaaaaaaaaaaacactagacataatacatcatagaatttccaccaaaaaaaagggtaacattttttgcccagttgaagtggacaggcattacttgacagagggtcttgattcagtgtgtatatgaagaaatggtagatttttaaatcttttttcctgtgcttagtgggcacaaaattgtaacaaaaattactatgtttcctcctgttcttgctgatggctagcataaaattaaactttaaaaatcctagctgtctttaatacaatgcttcccaaccttttacatttcacagtaaaataacaatttaaagttgtggggcataccaggttaactggacaagatgcttgaagccagaactcactggcctggaagcttctctgaacactttgcaggccgaggcatggttgtaacctgtttgtagcacccagtctgagaagctaggcttgaatgtaggccagactaaatatttgaaagtttaaaaacaccatatatatggtatcattttaattaaacgactgacattgtgattaaacaaaggaatgaaaatagcagttcctaagggctccgatgactactgcagcaatagaaataaacaattcctgttactcactcttacaccacattttagcccacatacatcaaactcagttttaggcaccaagactcactcaggcccaagaaggtagtaaggaattcctactctgcacattgcaagtttaagtttacgggcatccagtgccaaaatgtcacaagctaacctgcagaaactgaatgaccatggaatgctgaaattccaaaagaaaaacgtttcttcacttcaacctctgaatccagaaaaggactcatcatgtaaacagaccccaaataggttgccaggctatttacaaatttattacgaataaggtacatagtccaataccagtacaattttattttagaagtggaaggaatgaagagcagtggcttaagatttctatatagggggaaatccagtgaccatctagttagaagtgggagctggggaaagtgtcttgaagctcagcaagcaaagcaagcatgctttccccacccaaactgcatttatttgaagtgaacattagggagctgatgaggacgaggagggctatgataaaactctctgaagccaccccttcgtgccattactgagtgttagaaagtacctaaatttatttggtgctttctcatattaatactgtaaatggttaactattctcacattaggtggaaaacaagattaggtgttctacaaataggaaatagcaacaacttatgtattattttctcccataaactagcaagaaattaattcttaatgatttccaatatagttatattcacctttgcaaatgtccctgttcagcctacgctgtgcttagatggccatggtcattggttgtatttgtaaaataagagctaagcagaaaagaagattttaacatataatttggactactgaagaagtctttgaagagatttcttcgaaattttgggcaatcatgaagcaacagcagttttccttaagtaatcacaaggaatttgggtccttaataaaaataaaacttcattacatgatgtgtattgacaaattaaatgaacttactttctaaagtacaacaaaggcttcaacaatttttctgttgctataaacactaatttattaggaaacaggaactgataaaaatatcttaagttaacctgcacataaaagaaggctctgcctccaatgtgaatgagacagcggcaaacgggtatggatttacttgagaagtgctgctactgtaggcatagcaattggatttgcatttgaacaaagtcaaggttattagtaatgagaacagagacaaatctgagactgatcaaagtgggtacctaaatcagttcatgataatgttctttaatacatctggtataaatatatttgaaacactcattctcttaccttctgcagtttaatttgaagtttaggcttacaaagatttcccaaagttaatccaatgcatcccccctctataatttcatttcaactctagaagtcagaatgatatagtgacaagaacattcaataaggagctaggattcatgagttccaaaaaccctgactgctatcaacttaggtcattacttttagtaagtcatttactaggcttctaggtttgaaggagatcacctataaattaaagaccagctcaaaatttctgtgatcttacctaaaatatgtcattgtattataaataatcctgttactgtggatacaaataacatgtgtgtaagttttggatgtttgatttcttatgttacatggatttttctaggtgtacctttacagtttctgtcctatgctaactatatacttaggtctttaagttaaggctatattttttaagaaataaactcagggagcagagaccacttaattgtctagtaaacttggtgaactgtgcacgtggtaactaattgactgatattcatatataaagtaggtactttatattgcagtttgacaaatttagtctaattccatcatcagaaagaatggggcagtggaactcatttaatgagcttcaatataccaatatgttggctgggcatggtggctcatgcctgtaatcccagcattttggaaggtcgaggcaggcggtcacgaggtcaggagatcgagactatcctggccaactccgtgaaaccctgtctctactaaaaatacaaaaattagctgggcgtggtggcacatgcctgtaatcccagctactcaggaggctgaggcaggagaatcgccagaaccagggagttggaggttgcagtgagccaagatggcaccactgcactccagcctggcgacagagcgagactccatctgaaaacacacacacacataccctcaatatgttgattcatttgatgagaaatgattaaagaagaaatactgaccaagaccataatcaatactgcaatcaaatgaacattcttttctttagcagtctttaggctaataattcaatcttttgaatttaagctttctggatgttacctattacttcaaaattgttataatttccttaaatctaagcctccatgcttctatccttccccttttcacccctacaaataggattcataaaacatgtagtgggaatacgagaagtggactcaggaagagcagagctaactacttctaagtatatttggaaagttaacacattttgtcatgccacataactaattcctttaaagaaattgatatttaagacatttagacagtataggattatctggccatgcagatacatgaatgctgaattctgccacattcctagttataaaaagattcaggctaaatacaatcaaactattaatttgtattaatctttagcccattttggcacttagacagttggtcatctctgatctagatgttttataggtacatagttcagttcttcctacatacaacatcttatagcttctatatacctcatttcaaacaaaacagaatttcataaaagcctcatgtaacttctgtttctaccaatcattacgttacatgaaatagtatttgatcaataaggcaattctgtgtcaaattttatacacaatttgcttcttacaaaagaaagactaacatctagaatttattcaaaatgtgtcgtggtacaaattcctttaatgtcgccaacctaattcataacactgtcatgagaattactattaccttgtatgagttactccagggatcaacaaatgacaacctgtggactaaattgagcccatcgcctattttgtttactggaacatagccaaacatattcatttacatactatctgaggctgcttttaccctacaatgatggagttgagtagtttacaaaagagactatacacgaacagcaaagcctaaattattttatctgccctttatagaaagtttgccaatcctgagctaccctaagggtctcatcataatggaacttacagcagtcaaaacactattaccaacagaaaaaatagagtgctttcataaataaaacacgaggcacattaataaatggttattatattaaaatgcttcaggtatttaaaaccacccaaagttaatgctaaaatcaaaatgaatatgttccttccaatagtcttactatgtttcttcataaaacatttctgtaaacataataaaacttgttttaagtgtaacttgtgaatttatttgacttaatcacgtttaacatttttatttgatccaagcagtcgggcagaaattgctttgcaaatcaaaaactcacacataaatcaactacatacatgttagtgaataaaatttccttcaaatgtagtgaactaaatttttaaacatagtgcttttttcccaactaaatctgcttttctcaaaactgtataactttgtaattactttatgtttgtccctatagtctctgcaaaaacaaattttgattactttttttttttttttaccttgagatcacggtacacaatctttccggaatgtagatagtccaaggcagagacaatttctgcaccatagaaacgtgtgcggtcctcagagaacacccgctctctcgacaaatggaaaaacagctgcagggtaaacagcagggacaggattgtaataattactgatttagtgggggaaattaacacaaacataaaacacctctcatcaccatattgtgatgatagatagtgtactctcagtggacactgagcactcttagacagcagctggcttatcttttccaggtttccaaggggaaactgcgagctgttaaatcagcgttttaatcaatataccaatcttgtttaaggcattctgcttgctacccatttaaccttcagttaccagaggaaaaaggtatgcatcatcagattgcagtttccccctcactatactgttgcttcactcttcaaggattaggtattgagatattactaaaataaatgaacacaagcacagatatattttcacttaattatttgatttcaaagacaagactgtcaatttgctgaaactgatttacgcgaacttgttatattctacaatttttgattaatcatgatatctctaaaaatattttcaaagtcaaattattattgaaaatagaaaataatttgacattttctatggtgagaaactttaaggttttatgtttttaatttattttagtaatgcccaaaatgaactgagaaacatccattattcctattgcagttctcaatgtatattctattttcaataataattagctacaatgccagtcctttctcatattatcactaaaactataagcccatccatttcctagtcaacctcttaaaacatataccattcgatagtcaacaaacattcactgggtgcttactgtgaccaagtacacggctctccaataggccacttcttcattaaagaaactacaaatattatctcaattggacaacatacatgaagaaagagcaggtttcaggcactgtgaattgactattaatctttgttgttgaaacatgctcagaacaatgaaagattgtttacagtgctgagtatattgccaggtatcatggttattaatagatacacaatacatgtctgtgaaaaaaatgaaccaatcagccaatgtacccttgactgcaagatcagaaatttttcccttacatggatcattgactcataatgtttctacaaaattggtgaaaattatggttaactaagatttgttctgcatacaccaaagtcattatttcaagtaacataaaacaggttccctataaattcattcttccccattcccacccccaccttcacttaacagcatattataagataagctttatgcatgacccattggcatagtaaacagagagagagagaaaatatcacctatagccccaaaaagtgtagcacaacaataattatattaaaactaaaatattttgcagtctctaaactttaatgcttcctactatattactgtattttatcaaatctcatatgctacgaattgggactgcatcatcattttataaaacaccaaggtaaaaaaggttgtcagttaaaactataacacatgatctattctaaaaggcattctgattacagaaatgttaagtatgtcttccaaataatcaaatacagtatgtgaaaaatcaagtcatttatacaattactcagggatattttaaaaaattcattcatttcatatagttagatatatattatcaatgtattaccagcctaacaaggatagaaagtagaaggagccatgttttccaggttaaaataatttctgccatgcaaaatatcactaactttgatgaaaagatcgtgtgatctctatgtggagttgcagtagtcttctaatgagatgaaaatagtgattaggtttctaaattttcttaaaagaatgtcaagcctacttacccactcatttaactttacaaaaaatatggatcctccctaaatcgatataatatatgcaagattctagatctttatttagactatgtatcttcaatgtgtctgccagccaatttctataaatatatcagctaaaaattatatttaagggtaagaatttacttctcagtctgctatctgatgtgtacccttactactttatggaacttgttaagataaccaacaacctcttaatcgccaaatccaataatctatttacagtctgcactgcttcttccaaatctgaagcttaggacatcacctactgccctctttcttgaaacacatttctgggctttggtaatatgactctctcctgatttgcctcctaactctctggctaatccttctcagtttctactttggctctgaaccaacttttcaattcagcattcatttagtgagtatcaattattttaaagtcactgctgggcactggagaagagaaagagggaatacagtgataagacagaatctcttatgattccaagcattgagtgcggtaacattctcatgagtatacacttaactccaaacccatcaagttgttccgattaaatatatacagcattttgtatatcaatcataactcaataaagtggtttaaacaaaagacaattcctgccattaagcaatatgaatgaagaggacacaggtattgatttttaaaaaaagagggttgtgataacattttataactcagatattaaaagtactttgaaggcaaagagggattaatctgtgctggcatcatgtaaggagacttgatagataagaaaaagctttacctaagttttgaagaataggtttttcataatggaaaatttaagggaaaaatctccaaaaaagtgctactcaagttttatccatttgtatttccaacacagcctaggacagtacctgcacatagtaggtgattaataaaaatttagaaagcattaatactaaagaggaaaaatagcaatggcaagaaaacacatgtagggaacacatgtagccaaaaaataatatataatcagagaaataataggacttctggaaaaaaaagatgagatcagattggttaggatctttactaacatgacaagagcatgaattttttttctgtagataataagtatgaaagaattttagcttaaaaattagcataatttggatccacatatgcaaatcaatgaatgtaattcataatataaacagaactaaacacaaaaaccacgtgattatctcaatagacacagaaaaggccttcaaaaaaattcaacatcgcttcatgttaaaaattctcagtaaactagatattgaaggaacatacatcaaaataataagagctatttatgacaaacccacagcaaatatcacactgaatgggcaaaatccagaagcattctccttgaaaaccagcacaagacaaggatgccctctctcaccactcctactcaacatagtattggaaatgctggccagggcaatcaggcaagagaaaaaaataaagagcattcaaataggaagagaggaagtaaaattgtctttgtttgcagatgacatgatcctgtatctagaaaatcccatcctctcagtccaaaagcttaagttgataagcaaattcagcaaaggctcaggatagaaaatcaatgtgcaaaagtcataagcattcctatacaacaacaacagagaaccaaatcatttatgaactctcattcacaactgccacaaagagaataaaatacctagaaatacagctaacaagggaagtgaaggacctcttcaaggaaaactacaaactacggctcaaggaaataagagagaacacagacaaatgggaaaacattccaggctaatgaatatgaagaatcaatattgggaaaatggccatactggccaaagtaatttatagattcaatgctattcacaataaactaccatggaaattcttcacagaattagaaaaaaactattttaaaattcacatgggaccaaaaaagaacccacagagccaagacaatcctaagcaaaaagaacaaagctggagccatcacactacctgacttcaaactatattacaaggctatagtaaccaaaacagcatggtactggtaacaaaaacagacacataaaccaatggaacagaatagagaactcagaaataagaccaaatatctacaactatttgatttttaacaaacctgacaaaaacaagcaatagggaaggacatcctattgattgattgcttgattgaatgattgagacagagtctcactctgtcacccaggctggagtgcagtggcatgatcttggctcacagaaacctctacctcacaagttcaagcaattctcctgcctcagcctcctgagtagctgagattacaggcatgtgctaccacactgggctaatttttatatttttagtagagatggggtttcaccatgttggccaggctggtctcaaactcctgacctcaagtgatctgcccacttcagcctctcaaagcgctgggattacaggcatgagccactgcatctggccagcactccctatttaataaatggtgttgggagaactagctagccatataaagaaaactgaaactggaccccttccttataccttatacaaaaattaactcaagattgattaaagacaaatgtaaaaccccaaactataaaaaacctagaataaaatctaggcaataccattcaggacataggtacgggcaatgtttcatgatgacaacatcaaaagcaattacaacaaaagcaataattgacaagtgggatctaattaaagagcttctgcacagcaaaagaaactaccatcagagtgaacagacaacctacagaatgggagaaaatttttgcaacctagccatctgacaaaggtctaatatccagagtctacaaggaacttaaacaaatttacaagaaaaaaaaatccccattcaaaagtgggcaaaggacatgagcagacacttctcaaaagaagacatttatgtgaccaacaaacacatgaaaaaaagctcaacaccactgatcattagaggatgcaaatcaaaaccacaatgaaatagcatctcacactagtcagaatagtgattattaaaaaatcatgaaacaatagatgctagtggggctacagagagatgggaacacttttacaatgctggtgggaatgtaaatgagttcagccactgtggaagacaagtgtggcaattgctgtaagacacagaaccagaaataccctttgacccagcaatttcattactgggtatatacccaaaggaatacaaatcattctactacaaagatacgtgcatgcatatgttcactgcagcactatcacaatagcaaagtcatggaatcaacccaagtgcccatcaatgatagatggataaagaaaatgtggtacatataacccaagaaatactatgcggccataaaaaggaatgagctcatgtcctctgcagggacatgaatggagctggaagccattatcctaagcaaactaacgcaggaacagaaaaccaaacaccgcttgttctcactcataagtgggagctgaacaatgagaatacatgggcacagggagaacaccaccacacattagggcttgtggggcagagccaagggagggagatcatcaggaaaaatggctaatgcatgctgagcttaatacttaagtgatgggttgataggtgcagcaaaccaccatggcacacatttacctatgtaacaaacctgcacatcctgcacatgtaccctggaacttaaaaataaaataaaataattagcataatgttaaaaaggcaattcgggtagcaatgagagaatcaactaaaaatgcctgagactacagactgctaaacaatttttaaagtacaacaaaaaagttactgatcaccactgttatgaaaagctgcagacacaatgagagaaaaccgtaccaatctgcaaggacatcactatctggttacaagagccagatacataaacttttctactaaagttacggtaattattataaagcagaaaagacattcaaagaataagcatgtttggaaatatcagaagttatatttgagcttgcagagagcttctgagggacatcagctaaggtagtagtaacagacatataaagagaatcaatattccagagggaactagcttttaccacttgggtcaagggagaaatcaacgatgttgaggtttctctatggctgactgagtagatgctgatataaaggaaaagaatgggaatggggacagaggagcaatgggttttattttgacatgctgatatctaaataggcatttgataacacagctttgcaagttcatgaaggtagatatgggaatcattcatagaaaggatattgttaagactgagaaagcaaagaatagtctaggaattcagtaaaaactgaaaagataagtgaaggcagaatcttagggtactactatacataggacagaaaaaagcagaacaggacattcagatggaatactaagagatataaaaaaaggaagcaagactacaagaagtgaagggaaaataaagtttcagaaagacaggaacatttgctgtacttaggaattaggtcatctgttacttttcaaaggtaagttgtcatatttaggtgggctgaaaagagaatgtgaaggtagaaataatacaccattcctttaaaaaaatggatgaggtgagccaaggtattattgaaccagaaggtttctgtgcaacatattaaatagtgccttcaagaaaaaggtttgtctaaagaaattgacttatataactacaattcatatggaataggtacacaaatgaaacaccaaagaaataatgaagcaaggaacaggttattttaggttataaaaatttaatacagaatacttgaacatgacaatatatgataaagtatacaggaaaatgacaaatagtgcaacaataattaactctgaagaaacataaaatttaattttcacctcataacaaaataaaatttatatgtattagtccaatataaaattaaaaaactagaaaatatgtgtaagtggttatctagtctcaagatgaagaagaattttctaagcataaaagaaatggaagaaatagactttttgcttttccccaagagggtgggttagaggctttctgcacgcctcagccacttggacatagcaagatagcagataaagataaactctgtgagctttaattcaagaaggaaaacaggaatctactggaatcatgacgtacactccagatcccagagaggagaaggccagcaaacagccccactgacggcatccagctgataaaagttaagtgaagccccagtgcatgagagaggcaaggagcctccctctgtgactcacccttccactggggatccaagcaacctaggccaagggagagcactttgtttctcccagtcctggagctaacttggggagtggcctggagtcactgtgacggaaaaagctgaaggcatttttccagacccgggaaaaagagcaggacaatgttttaaatttgggcacataaaaactcagccattccttggtgacccagcagtgtggctgcacaggcatgtcagtcttggaccagagatcaaaacacctgctctggaatgggataggggcttcacagtcaaaactgtggaaagtaccccaacaacagggctagaattgtgctttccccactttcaagcctggggcagcaggagagccgctacagctgcagtttctcctgggctgcaaaacttgcagtcacgttcagcttggcaacctggaacagattcgcatgtgccattgccgggtaacccactctgttctcctgagattgtggtgcagtagggcccttgctgctccatctccaagcacatctctggcatccagagtaaccatttgcctagttgagtagcctgagccaccgcactcctcctggacataacgttatggtgaagcagagctctctctgctccatacccaggaagatccctaggcattcagagcacctccttgcctgcttctggagtttgagtcaccccacccctcctatgcagagatcttagtgcagggggtctctgctccatgctctaggcatcttgagcacctactctcctggactagaagtttagaccatcccctatccctgtgcagagaacttggggctgaggaggtttcccagctacactactaggcacatctctgggcccttggtggccacccactgcattctccctcggcactagtgcctgtgtctgtcatcaggggacctgtaggtggacctgtcaggtctggccctgccattcctgccctctgccaaccccctgaccctggggctgggcagtgagctcagaccatggtacattccatgaattggccatagcctgtggcaacaaagagcttctgccagtaaacaagtatcaaggtatacactaagccatgttggctgcagttagctcttacctctaagtgccatctacaggcttgcaggtcaaatgccacagcccaaaataaaattggccaaaagcagcacagaggactaaagaaacaaagtcaaagaccctacccagaattctctatagtcacattctgaagggaggggaagaaaagggaaaggagaaaaaaatatataataacattatagggaaagaaaaagaaagaaaaaatcctacctgcatgaaaataattacagaagttacaagtgttagggtctccagataagaaaaaagcagcgtaagaattccagcactatgaaaaatctgaatgtagtgataccaccaaaggatcacactagctctacagaaatggtccctaaccaaaatggaaactcagaaatgacagataaagaattcaaagtagggattgcagtaagcccaatgagatccaagacaaagttgaaaatcaacaaaaaaaaacttctaaagtaatccaggaaatgaaggaagaaataagcatctttaagagaaatcaatcagactttctggaattgaaaaaattcacataaggaatttcaaaatacaactgaaagctttaacaatagaccggcccaagcagaagaaagacttgcagagcctgaagaccagtattttaaactaatccagtcagacaaaaataaagaaaaaataattttaaaaaatgaataaagtcttcaagaaatatggaattacagaaagtgataaaacctacaaattactggtattcctgagagagaagaagaaaaagttaacaatgtggaaaatatatttgaggaaataactcaagaaaactttggtaatcttgttagggagacagatatccagatacaagaaatccagagtacaactgtgagatactatgcaaaataaacatcactaaggatattatcaccagactgtccaaggtcaacactaaagaaaaaaaaatcttaaaggcagctagagaaaaagggcagatcagagggaatgtcatcaggccaaccgtcaacttctcagcagaaaccttaccagccaggagagactggggacctatttttagctttctcaaaaaaaaaaaaaaaaaaaaaaaagaaattccaaccaagaatttcataacctgccaaaccaagcttcataagtgaataagaagtaaaatcttttccagacaaacaagcacaaaggaatttgttacaactagaccagccttatgagagatccttaagggaattctaaatatggaaatgaaagaaaaataaatgctaccacaaaaatgcatgtaagtacatagcccacagaccctataaagcaaaaacacacactagaaagtgtaaggcaaccagctaataacttcatgataggatcaaaacatcacataacagtattagctttgaatgtaaatggtctaaacacctcacttaaaaggcacagagtggcatgttggataaaaaaacaagactcatccatctggcttgtcttcaagagacccatcttatatataatgacacctataggctcaaagtaaaggtttggagaaagagctaccacactaatggaaaacaaaaaagagcaggaatcactattctttcatctgataaaacagacttcaaactaacagcagttaaaaaaaaaaaagacaaagaagagtattacataatgataaagggctcaattcaacaagaagacttaactatcacatatatatcttccatatatatatatatctctctctctcttccagtatgtatatatattccatatatatatctctctcttccatgtatatgtgtgtgtatatatatatatatatatatatatacacacacacacacacacatatatcttccatatatatatctcacatatatgtatgcacccaatattggagaacccagagtcataaaacaagtactactagatctacaaaaagacatagacagcaacacaataatagtgggggacttcaacaccctactagcatgagtgagatcattcaggcagaaaagtcacacattctggacttaaactcaacacttgaccaactgaacctgaaaaacatctacagaatactctacccatcagccacagaacatacattcttctcaggtgcacatggaacaatactccaagactgaccacatgctcgtccttaaagtaagtctcaaaaaaaaaaaaaaaagaaaaaaaaaagaaaaagaaaaagaaaaacaaacaaaaaaaccctgaaatcatactaaccataatcttggaccacagtggaataaaaacagaaatcaataccaagaaggtatctcaaaaccatacagttacatgaaaattaaacaacttgctcctgaatgtcttctgggtaaacaacaaaatcaaggcagaaataaaaatagtatttgaaataaatgaaaataggtacacaacacaccaaaattccagggacgcagcaaaagcagtgttaagaggaaagttgaaagcactaaatgcctacctcaaaacattagaaagatctcaaattaatactctaacatcacatctagaggaaccaggaaaacaagaacaaactaacccataagctagcagaagaaaaaaaaataactaaaatcagagcagaatggaacgaaattaagacctaaaaatccacataatgaaatgatgaagccaaaagttggttctttgaaaggataaagaagattgctagactgctagtgagattaacaaaggaaaagagagaagatataaataaccacaattagaaatgacaaagattacattacaacttatcccacaggaatacgaaaggtcctcagaggctatgtgtctatacatacaaacaagaaaatctagaggaaatggataaattcctggaaacacacaatttaccaagactgaatgaggaacaaattgacacactgtacagactaatatcgagttccaaaactgagtcagtaataaaaaaaacctaccaaccaaaaaagtcccaaacaagacggattcacagttgaattctatgtaaggtacaaggaagaggtggtataaattctactgaaactattccaaaaaaatgattttacaaagccagtaacatcctgataccaaaacctggcaaagacacaatgaagaaagaaaatcacaggactatatccctgatgaacacaggtgcaaaaatcctcaacaaaatactagcaaactgaattgaaaaacacatcaaaaagttaattcaccatgatcaagtaggcatcattcctgggatgcaagggtggttcaacatatacaaatcaataaatgtgattcaccacataaaccaaattagctttcaatgaaatccaacatcactttatgataaaaaccctcaacaaactaggcatcaaaggaacatacctgaaaataataagcaccatctatgacaaacccacagccaacatcatactgaacaggcaaaaactggaagcattccccttgagaactggaacaagatatggatgccccctctcaccactcctagtcaatatattagtggagagtgctagccagagaaaatcaggtaaaagaaagaaataaaaaggcatcctaataggcaaagaaaaagtataactatctctctttactgataatgattcgatactcaggaaaccctaagggctccaccaaaaggctattagaactgataaatgatttttgcaaggtttcaggagagaaaatcaatgtacaaaaatcagtagcatttctatatactgataacatccaagctgagagccaaatcatttacaatagccacacacacaaaaaaatccaggaatacatctaaccaagaaggtaaaagatcattacaaggagaactacaagacaccgttaaaagaaatcatacatgacacaaacaaatgaaaaaacgttccatgctcagggactggaagaatcaatatcagtaaaatagccatatttccctgcccaaagcaatctacagattcaaggctatacctaccaaactaccaacatcatttttcacagaactggaaaaaaaaaactacaaaattaacaagaaaccaaaaaagagccagaatagccaaagcaatcctaatcaaaaagaagaaagctagaggtatcaaattacctgccttcgaaccatactataaagctacagcaaccaaaacagcatggtactgtaaaaaaacagacacaaaggccaatggaacataatagagagcccagaaataaagccagccacctacaataatctaatctttggcaaggctgacaaaaataagcaatggggaaaggactccttattcaatatatggtgcttcgacagctggtgagccatacgcagaggaatgaaactggacccctatcttttaccatatacaaaaattaactcaatattggttaaagatttaaacgtaaaacctcaaactataagaatcctagaagaaaatctaagaaacaccattcttgacattggcactggaaaaaattatatgactaagtcctcgatagcaattgaacaaaaccaaaaatcgacaagtgagacctaattacactaaagagaatctgtacagcaaaagaaactatcaacagggtaaacctacagaatgggataaaatattcataaactatctgacaaaggtctaatatccaaagtgtataagaaagttaaacaattgaacaagctaaacacaagtaacccaataaaaaatgagcaaatgacatgaacagacatttctcaaaagaagacatacaagcagccaccaaatatgaaaaatgctgcacatcactaatcttcagggaaatgtaaatcaaaaccacaatgagatatcatctcataccagtcagaatggctgccattaaaatgtcaaacaataatcggtctaatagtacaataacatgttgacaaggctgcagagaaaaggggatgcttgtaacactgttggtgggaatgtacattaattcagccactatggaaaccaattctgagatttttcaaagaacttaaaataaagctaccatttgacccagcaatcacattactgagtgtgtacccaaaagaaaacaaattgttctataaagtagacacaggcacttgcatgttcattgcagaactattcacaacagcaaagacatggatagaccggattaagaaaatgtggtgtatatatatatatgccatggaatactatgcagtcgtaaaaagaacaaaatccggtcctttgcagcaacatggatgcagctggaggccattatccggagtgaattaacacaggaacagaaaaccaaatactgcttgctcttgcttataagtaggagctaatcaattggtactcatggacataaatatggtaactatagaaactggaaactactagaggaggggaggggttaaaaagggtggaaaaattaactgttgggtaccatgctcagtacctgatcatgggatcatttgtatgccaaacctcagcatcatggccatatacccaggtaacaaacctgcacaagtaccttcttgaatttaaaataaaagttgaaaaaaataaaaaagaaatggaataatgaagggaaaatccagtagatttagccatataaagtagcaaagatagaaataaaatggagtatttataacatgtgacaaagctcatattcttaatataaaaaaaaattaaaagactaaaacacaaaaaattgggtaaaggtacaattaacctgagagggctacaaattattaatgtatatgaacataggccaccttgtaataatcaatgtaacagagacaaaacttaaaaaagggcaattttaaatttatgaaaaattagtattgtcagtgaaagtgaggtgagataagcatctttatacactggtggctagtatgtaaacagacagtctttgcaaaacaatctggcaatagatagcaagataatttttaaagttcggtagttgctctcctagaaatttccttaaaaaataaaaatatacgctgggtacagtggctcacgcctgtaatcctagcactttgggaggccgagactggcagattgcctgagctcaagaattcgaaaccagccctggcaacacagcgaaaccccgtccctaccaaaagcacacaaaaatagctgggcatggtggcgggcgctgtaatcccagctactcaggaggctgaggcacaagaattggttgaacccgggaggtggagcttgcagtaagccgagactgcaccactgcactccagcccaggtgacagggcaagactccgtctcaaaaatacatacataaatacatacatacatacataaaaatatagaagccatcttctacacaaggatattttcagaagtatatacattgagaaaaatgtgaaaacggccttccaaccaggttgaagaaaaattagatttttacctcacaatataatacgataaatttcagattttttagtattttaaatttcaaattttttatattttttagttaactactagttaagaaccagaatatatgagtgaaaagtcaacaggactgaacttacccaactgccctaaacatttgatgggcatatctaaaacagaagatgaaaactgagcaaatatataaaagaactctcattagatactggacaagaggaagtgcatgacgatggtacctgttacaacagaaacaaatgaggtgagccatatgattatccaccttttgtctgggggcactttctgacacattattgaggaagaaaaatcacaaacctaattcaagggtttcactgctgaaaagataaacatcagattttgaggatgatgaggtagatggcatttgcaggacagaacactaatgaggaggaagctatacagaatctgcacagttgagtctgcagttgaatactaagcaatgcatgtgtagggtttaactttatgaggacaagcagagaaggaaaggaaagctgtaaatatgtagtagctcttagagctcacgcagagctgagagacattcaatttttaggcagtcagagaagagtcattactgaactctcaggcattcagtagatatctcaagagtcagagtgaaacctgaacttacacgaacaaagctaacatcaatactgaaatatcaatcatatttgtaaatactgccttccagaataaaaactaacactctgacagaagaaaacaaaatccagtaactcacgtaaaactcaaattatctaatcaatggaagagaatcaaaagccaaaaataaatccatgcctatatggtcaacaaacatttgacaagggtactgaaaatacataagggagaaagaacaatctcttcaataaatagtgctaggaaaactggatatacacatgcaaaagaatgtaatggagtcttatctttcatcatatcaaaaaaccaactcaaaatggattaaaaacttaaacgtaagacctgaaactataaaactcctagaagaaaacataccaaaaaaacctccttgatattggtcttggcaagtatttcttggatatgacaccaaaagcacaagcaacaaaggcagagataaataggtgggactactatttatctctttgcttatgtgaagcaaagaaaacaatcaacagagtcaaaaacctatggaatgggagaaaatacttgcaaataatatatctgataagaggtcaatatcccaaatatatacaaaactcggctgggcacagtggctcacgcctgcaatcccagcactttgagaggctgaggaggatggatcatgaggtcaggaatttgagaccagcctgaccaacatggtgaaaccccgtctctactaaaaatacaaaaatcagccaggcgtggtggcaggcacctgtaatcccagctactcggaaagctgaggcaggagaatcgcttgaacccgggaggcagaggttgcagtgagccgagattgtgccactgcactccaacctaggcaacacgagcaaaactccatctcaaaaaaaaaaaaaaaaaagaaaaaaaaagaaaaaagaaaaaaaatctgatcaaaaaatagggaaaggacctgaatatacttttcaaagaaaatatacacgtggccagcagatacatgaaaaggtgctcaagatagatcactagtcaacagagaaatgcaaatcaaaaccacaatgagatattaccacacacctgttaggatggctattataaaaaagatgagatagcaagtgctggtgaggatgtggagaaaagggaacccttgtgcactgttggtgggaatgtaaattggtatagccattatggaaaacagtatggaggctccataagaaacgaaaaatagaactatcacataatcctgcaatctcacttctaggtatatatatctatctgaaggaaatgacatcaatatttcaaatagatatctgtactcccacatacactgtagcattattcactgtaattaaggcaggactgcaggtatctctattccaagaatggaaacactctatatatatagatttcttggatatgaagaagcaacatctatcagcagataaatggataatgaaaatgtggtatatttatacaatggaatattattcagccataaaaagaaggaagtcctaccatttgtgacaacatggatgaacctcaagggcattatgttaagtaaaataagtcagggatgacaaatactgtatgatccacttatatggggaatctaaaagaatcaaactcacagaaacagaaagtagaatgatggttgccaggagctggggtagggaggtaagtaaaatggggagatacttgtcaaatggtacaaacttccagttacgggtaagttctggggatttaatgtacagcatcatgactatagttaatgatactgtactgtatatttaaaatttgctaagagagtaggtcttaggtattctcatcacacacagacaaaggtaactgataggtgacagacgtattcactaattcaattgtggcaatcctttcacaatacatacacgtatcaaatcactacactgtatacctaaaatttatacaattttatttgttcattatacctcaataaagccaagaagaaataaattaaaaaaagaaacccccaagaacaaatgatttagcatccaatcaacgtttactaaacatgacaagatgcaagaaaatatgacctataaccaagagaaaaatcagtcattagaaacatacctaaaaatcagagatgatggaattaatagatactgacttcaaaatagtacatgaacataaagaagagataaagggaaatagaaacaaatgagactgtagagataaaacaaacaacatctaaaataaaaaattcactagatggaattaacagattcgacactgaaagagaaaggacttctgaatgtgaaatcatagctaaagaatcgatataaattacaactgggaaaaaaaagcctcagtgacctgttggacagtatcaatgaatctaacacatgtgtaatataaattactgaaaggagaaagacatttgaaaaagaatggctgaaattttctaaaattggataaataactaaatgcacagatctacagttgcccaggagaaaagggaaatgaataaggtgatagttatgattactccagctggatacctagaaacaatgtccaggctgtaacacagggagaggaaaacaaaacaaaacaaaaagagcctacgaggatccttgatttaatgatactgagttcagagactggggagaccaaggtatctagaattcatgagacaggtaactagacagaagacagtaccaaagacagagctcgagagatctacaatggattgcctcggagtctcattgagcagcacctgtatgtggggaaaagctacggaaagagccactgaaaaggaccagatgaaacaatcaccaggctaacagaaaggcaaaaatatttcatgttctcacatggcaaaatagaaagatctcctaaaaactatggcatctaacagagttttaaaaaaatactgcctcaatagtgcagccgtgttagtgctagagcaaaggatattccagaccagtcttactaagcttaaaagcaagcactgataggatcatactgtttatacataagaataatgcctaaatatattttttaatccccaaacttccagcatctgacaatgtaaaattcaatgtctggcatccaataaaaaattaacggacataaaaagaaacaggaaaataataacctataatcaggagactaatcaatgaatagaaacagactgagaaaatgacacataagatataattacacgaataccataataaattagccgttgaaaatataaaaaatagctgttgaaaatataaaagttcaaaaggtagagggaagcacataagatgaagatgaaaaaaaaagtcccaaatcaaacttcaagagatgaaaatgtctgaaataaaaaatatactagatgttactagacactggagaagaaagtattagtaaacttaaagacacagggggaaaaacccaaaattaaagacagagaaaagactgaaaaaaagaagagaacattagtaaacagtgggataacatcaagatgtctaacatgtaaataagtagattctcaggatggaacaagagaaatgagtaacaaaatacttacagaacaatattcaaaaattttccaaattgaatgaaaactatatgcttatagatccacaaggcttaaaacaccctaagcctggccaggcacggtagctcacacgtgtaatcccagcactttgggaggccaagctgggcggatcacgaggtcaggagatcgagaccatcctggctaacatggtgaaaccccgtcgctactaaaaatacaaaaaattagctgggcttggtggcaggagcctgtagtcccagctactctggaggctgaggcaggagaatggcgtgaacccaggaggcggagcttgcagtgagcccagatcacgtcactgcactccagcctgggcgacagagcgagactccgtctcaaaaaaaaaaaagacaaaaaacaaacaaacaaacaaaaaaccctaagccaaagaactgtgaaggaaaccataccaaggcacatcataatcaatagctgaaaggaagtaataaacagaaaagcttaacagcgaccacagaaaaaaagacacatgaagcacagaggaacaaagcagacttcttgacagaaactgtataagccagaagaaagtacagtgacatttttatagtaatgaaatgtaaaaatggcaaattagaatttcatacatagctaaatatctttccaaaaatgagaggaaaataaagccattatcagacatgtaggttagagaactcaccaccagagacactgaactagaaattgttcaagaaaatgtttcagaatgaaggaaaatgacaccacatggaaaacaggatctacccacaggacagaaaatattggaaatagtaactgtgtcagggaacagaaattaatttttcttctgttttaaatttccttaaaagataatcactggtttaaaacaaaaataataatgcatagtggcatttataacacatacaaatgtaaaatgtattgtaacaacagtacaaaggcttgaaggaggaaataaaagtataccagtgaaaggatcttaggatgtatgtgaaatggtataatctaagcggaacacaaaatgggaaaaaaagttaaatacgagtttatagttaaccgtcatcccacaataaaaactggagctcccaaaagttactgatgaattccaccacccctttaaagaagaaataattacaattttatagaaacactcccagaaaatacgagaacagttgttaacacgttgcatgaggccagcattgccacaatacaaaaccagacagaactattacatgaaaagatgagtacagatcaatatccctcaaaatcatagatgtaaaaacttaacaaaacttctctaattcaattccaacaacatataaggatgataatacattatgactaaaagatggttaatctcaagaatgaagactggcttaacatttgaatgtcaatgtaatttatcaaatgtacaaactaaaaagaaagccgggcacagtgtctgtaatcccagcactttgggaggcctaggtgcgtggatcacttgagggtaagagttcgagagcaatctagctaacatagtgaaaccccaactctaataaaaatacaaaaattagctgggtgcagtggtgggcacctgtagtcccagctgcttgggaggctgaggcaggagaatcacttaaacctgggaataaacctggaagctgcagtgagctgagatcacgccactgcacttctgcctaggcgacagagtgagactccgtgtctaaataaacaaccatatgatcacctcaatggaggcacaaaaacctttaaagaaaagtcaatgtccactgatggtaaaatattctaggaataggagagaacttaacctaataaaaggtatatatgaaaaacttatgactaacatcacacttaataataaaagacttaatcttttccgagacagggaacaaaaacacaatgttcgctacttttgttcaacactgcactagcagtcacaggcagtgaaagatgcatagacagatagacaattaaacagacaaatatatacatgccatacaaacaagaatggaagtaaaactgctattatttacaaagagcaagactatctacatagacatttcaaagaaatttagaaaaagggtttctagaactaataagtgagcttaggaaggccatggaatacaaggttaatatataaaaaccaactatattcttatatgctaacagcaaacaattgtaaatgggaaaaaattggaataggtaaagaaaaattgaaaaattatacaaacctatacactaaaactacagtgtttcaatagacattagagaaatccataagcaaacagagtgtgtgtccatggattagaagactcaatattcttaaatagatttatggattaaatgcaatcataatcaaagttacagcagacttttttgtaaaaattgacatgataataaatttatatgaaaatgcagaggacacagaagagtcaaaacaattctgaaaaaagaacaaagtttttctctatttcaaaatatactcccaaagcaacaattatcaagttagcgtggtactgatgtaaagagaaactcaaagatcaattaaacagaataagacagtgcagaaacagacccatatgtgtgacaaactgattttcaacagaggtacccaagtcacacaatcagagacagggtcttgctgtgttgtccagtctgcaatgcagtggtatgaacatggatcactgcagcatcaacctcttgggctcaagcaatgctcccaattctgccttgcaccaccagtccaggctaattttttaaattttttattttgtagagacagggtcctgctgtgttgcccaggctggtctcgaactcctggacataagtggtcttcctgcctcagcctcccaaagtgctgggattacaggtataagcccccatgtctgactaaaggacagccctttcaatgaaagatagtgaaagaacaagatgtctgtagggggaaaaaaatgaacctcaactcttagctcacagcatacataaaaattaaaatggatcacagacctatacatgtaataggtacaacttaaaaagttttagaagaaaatacagtcatgcactgcttaatgatggggatacattctgagaaatgtgcaattagacaatttcatcattgtgacaacatcctagggtttacttacataaacctaaatggcatagcctactacttctaggtacagacctgtacagcatgttaccctactgaatactctaggcaggtgtaacacaatgatatttgcacatctaaacacatctagaaaagtacagtaaaaatatgatatagaagatttaaaaacgatatacctgtctattgcatttataataccatgaatgaaacttgtaggactggaagctgctttgagtgagtgagtggcgagtgaatatgaaggcctaggtgattactgtagactatgaacactgtataatgtataaaataattaaaattatttttttcttcagtaatgagttaacctttgctttctataactttttcactttatacactttaaaatttttaaaaacgccttgactcttttataacagtttaaaatatgaacacattgtacagctatacaaaaatattgtttctttacatctttataaatatttttctattttttttaacgtctttaacttttggttaaaaatgaaaacacagcatatacgttagcctaaacctacacagtcaggatcatcagtatcactgtcttccacctccacatcctgtcccactgtaaggtctttcggagcaggcatcgagtagtcatctcctacgctaacaatgccttcttttggaatatcacctgaaggacccacctgatgctgttttacagttacctatttttttttaaataagtgaaagtaatacactttaagaaacaatgaaaagtacaatatataaaataaagaagtaacacagtcatgtactatcacaatcaagtattatgtatctaactgcatgtgctatgtttctacacaaccggcagcacaggtttgcttacaccagcatcaccaaaacatgtgagtaatgcactgcagtatgacttacaacatttacatcactaggcaatatgaatttttcagctacattataatcttatggtattgtcatatacatggcccactgttgacagaaacttattatatagcacgtgacacataacaaataggagaaagatgtgtgacctggggtacacaaacatttcttggacagtacacaaaaaaagtgaaaaccataaaaggcaagaattgataaataagacatcaaaattaaaaacgtctgttcctcaaaagacatcactgagaaaatgaaaaggcaagctacagtctggaagaaaccatttgtaatacaaatatttggcaaactatttgtaaccagaacatccaaagaactcctataattcagtaagaagatgaacaaccgaataataggtgaaatatttgaatagacaggtcacaaaagtatatgcaatggcaaaaagtctgagtgaagacatttcctatcattagtcataagagaaacgcaacttaaaaccacagtaacatactcccacacactcgttagaatgactaaaatgaaaaccactgaccacagcaagcactggtgagggtgcagaacacctaaaattctcattacattaatgctgagactgtaaaatgacacaacagttttaaatttttgtaaaatgtaagcatatgcttaccataaatccaacaatcatactcttcagtattaattaaagagaaaagaaacaggcctatcagctttattcatattaggcaatgactggtattaatccgcatgtacgtcaccagtgggagagattaacaaatggtggtatagctgtgcaaaggataatgacttcacaataaaagaaataaatgactgagaaatgcaacaaagttaacaatctcaaaaaacattacgcagaatgaaagaagtagatacaagacagtatatattgtatgagttcatttctgtgacatttttaaaaagatgaatcaaatctttagtgtctgaaagcagaccaatggctacctagggccacgtgtggatgtactatgggtacagggaagactgactgcaaagaggcatggcagaactttttgaggcaatgagaatgttttatatttttattgtgatgggggctacatgcatatatatgtttgtcagaagtcatctaatcatatacttaaaatgagttcatttcattatatgtaaattatacttaagttgactaaaaaatgaaaacaacctaaacgttcaatgatttgggaaggttttaataagttaaagtgtatctacataattagtaggcaacaagtaacatattttaaaatgataaaattgaaaatatgtgtacagtataaacagtggaaaatatattaacacggtattagcaattatttctagatggtaagatttagagtggtttttatcttctgtttcatacctcaaaaaatacttgtaattatttaatatccattccccagaatactatgcatttttgttttgttttgttttgttttggtgacagggtctcactctgttgccaaggctgaagtgcagtcgcatgatggctcactgcagcctcaacctcttgggctcactcaatcttcccacttcagtctctcgagtagctgggagcacaggcactggctaccacacctggctaatttttaactattttggtagatacagggtctccctatgttgctcaggctggtcttgaactcttgggttcaagtgatcctcctgccttggcctcccaaagtgctgggcatgagccactgggcctggcctatgcccttcttaaatgcagagaccatctgtcttgctcatgtagtatactaagcacatagtacagtgcctgccttgaagaaagcagcattcaataagaacttttttgacagaattaaaataatttttttggctttttgaagttctctgtaatgaatgtacattatcacttttgcaatagaaaaaaattattcaaaggtttcaaataaatgtactaataattaatgtactgatttatgcttattataaatttaatgctctatttttttcttggcaaaggcataggaaaatgagaaaattatgacagtacaccatatctttgcatcttcagcaccatgcctagtatatgacacatattatattcttcataaatatgtattgcaaaaaataaaattaaattcagaaatacctctcaaaaaattataagaaaaatcatccttaaggtttttgaggtaaaatattttcattggaagtattaaaaatcatatataatagttgaataatcttatctttgttcaaaaaggaaagtgaattatttgctgctaaaatagggagcttatctttatcaagttaagttcctttataaaggcaaagactacatagtttttttttattgttaagcttagccatgctataggaatacagtaatgtaaaatgcattaactcaaactactaaatatacaagcatatttcatcattctattaggaagaaattttctccataactctctctcataatagcctaacaggaactgcactagagtgtagctgtactcccacggtttagtaagtgaacaggtattcagcccatccttgcaaaaagatgactgcatctacagccgtgccctaaagtctcatgctcaacaggcttctctcatcagagcacaggaagttccttcccacatacccttcaaatgtcaacctaacactacttcctcaaagagataactaaatttatagtaggttctccatcattctctctcatactacagcactctgttgccattatatttattgggtttattttgttttattattttataatatgcatctccttctagaaatcatgactgttttattcatcctagcgaacgcagtaagcatttaatacatacttttgattgaatgagctaatcttatttggggaacatacctgttcttgaagatttagttcaaatgcacctttcctcctaaaatctcctgtataggagaacatttgtggggatgttatttttatcgtggtgatgatttcatgggtcaaaagttatcagattgtacactttaaatatgtacaaattatttataatttgttattaactcagcaaaactgttttaaagaaagggaaacatcttaagacaaaatgcagattttctcacacaaataaaagctaacaaaagttacggctatcagacctgcactacaaaaacaaatgctaaaggaagtttttatgcaaaaggaaaatgtaatagatgaaaatgtataccaacacaaaggaaaagagaacacttaaaatgactactttatgaatataaaacattttttctattaaaaattattttaaagataattgcttaaggcaaaaacagtgtattgtaaaggttaaaaaatacatggaagtaaaatgtctgagaacaactgcacaaaagacagaaggcagggaaacagatgtatgccttttaaggttcagatagaaggtaagaaaatagacgtatgctgttataaggttcttacagtacaggtaaagtgacacagcatattgtttgaaagtctaccgtgatgagaaaagatacatattctaaaccctaaagctaccaccataagaacaaagaagcagagctaatcaaactaagattatttaaactcatcaaattactaatagaaattcttcaacttttaataaagagcatctacgaaaaatctacagctaacaacatggttaatggtgacagtatgaatgcttctgccctaaaattaggtataaagcaaggatatttgctcttatcctgctctttaacactgttctaaacatcctggatagtttaataaggcaaggaaatgtacacatattagaaaatagcagtaaaactgtctttgttctcacctgacatgatcatctacatagagaaatccaatatatttacaataaaagactactaaaactaatattagtatggctaataagtaaacatcaactgtatgtctatatattagcaagaatcaactacaaattgaaatttttaataatgactgataaaccatttataacttaaaaacataaaataattataaagtatccctaaggataaatttttaaaactttcaagacctgtacactaaaaactacataatattgttgaaagaaattaaagacttaaataatgggaaaacatataccatatttatgaatcagaagacaacactgtgaaactgtcaattctccccaaattgatcaacagatttaacacaatcacaattaaaatccaggaggcttttatgtagaattcaacaagcttactctataatttatgtggaaatgcaaaggaaattggatagcaaaaccaaatttaaaaagaatatcaaaattgaaagattcaagctgcctgattttaacacttattctaaagtaagtgtgtggcatagtgaagacagtgtggtataggtttcaggatagatatagaccaatacaacagaatgcagagtccagaaatcgacccacacatatatgactgatttttgacaagggtaccaaatcattcaatgggagaaagacagtcttttcaacaaatatgctggaacagttagatatcactttgcaagaaacaaatgaaacatgacccttatgtagcagtatacattaaaattaacttgaaatggctcatagacctaaatgcaagagctaaaactattaacacttctagaagaaagcataaaagaaaatctccccgacctgccaccacccaacaggtctagctttgactttagaaaaaaatcttaacaaacttcagttagaaaaagatgttttaaaaacaaaatgtacaaatcataagagaaaataatcaatgaattgtgtttcctctaatttagaagtctgcccttcatactggttggaaagcctatcagtggttttcagggtgagagtgaggggagagaattgactttaaagagacatgcgaggctctgttgtgaaagaaacattctagatcatgattgtggtgatgggaaactgctttatacagctgtcaaaactcactaaattgtacagtcaaaattgattaattttactgaatgctaactatgcattaaaatgctgattacaatagattacaacaaaagtgtattttggaacaatttcccattatgaaatgaaaagacaaactataaaatgggagaaaatatttataaaatatatatatgataaagcccttacatgaaataaataaatctgacaactcaatattaagacaacaacctaatttttaaaacagacaaaagattttaagatacttcaaaaaagatgatgtataaatggcaaatcagaataagaaaagaagttcaatatcattagttatttgagaaattcaaattgaagctaaaaaataccactatacatccaccagaatgagtaaaatttaaaaagactaccatgccaagtgtggtgatgttgtcaagtaacatcctgggaatgcaaaatggtatggctgattttgaaaagagtctgcagtttttaatgaagttgatcataacaaatgacacagaaattgcatttctatgtatttacccaagaagattaaaaatatatattcacacacagatttgtactggaatattcacgagcttttattctaataggcccaaaatgtaaagaacccaaacgtctatccaggggcaactatataaacatatgactgtacatcacacaacggagcaaagccataaaaagaaacaaactactgatatatggaacagtatctataaattttaaaagtattatgctaagtgaaaaatggagaacacaaaagcctgtaagtatgttttcagattatagtttttgatatttaaatactgttttgtgtcactgccctctttttcctcctcagggtttccaattatacatatgttgcttcttctgttttccctcccttgaaatacccactctgtggtaagccagcctttgtgtaagaagtttgactaccttgaaatggccatgctctgccataaccacatggaaaggaatcatgtaaatacccagatgcctggcaggcccctgcagttccagccacttgatctgagattttagatttgtaagcaagcatgttacatgttgaggcttgtaataacatctcctaataactaaattcaatgcattcaattacatttaatgcagtgagatactggtttaaccattcattttttaaaaatgtctttgaattatgaaattatatactaaaaatgcttcccgactttacattgcctttagatgctaatgtaaacattgtaatgcatccttcttgacttgggaattttgaaaaagcattgggtgaaaaacaaaattctgatacaacctacataatatattaataactaaaatagttagcaaagaaattagcttgtcagacacctgacaataaagatgtttatatacctgaaaactttgtaaaattttaaaaatcatcactatgaatatgaaatgataattaaattaatttaaaaatcacccagatcacacctccgtaaattagtaaggagaactagaatactgactactggtgcttttgtcttatgtgaatttaaaatgagataattttggttcactgataacaaaatgccagccaaatgagaaatctgaataagcatgagaatctcaagaatggcaagaacctgaaagccgtattgcaaaaaaatcaaatacatgttatcaaagaaattaatatagagtttacaatgaactaagtatggacaaaaatagtagtacataactgaaactgttagcttcattacaacctacataaagaaaatagaggaatgtgaagaatttatcagatgaatagcatttctacacaatgattttcctttactcccctaatgaatctttaacttcaggaaacttcagacttgagagagatttgcagaggtccaacaaataagcctgaaataaatgaagctatgagtaagattttggaaacaagtcctaagtagagacttcctaaaccaaagaaaacaaaaacacctccttagtcaattttgtctactttattctcccaggatatttttctgcttctcatgtaaatttagtaacatttaaggaataaaaagagagctgcctggatatattagcagtgtgattggtcatattattagagagattttacaatcagttctacaaatgccccactgaaattgcactgaactcactcttacaaccttgttctactgggctccaaaccaacccttttacattctgtactacagccaaggtgcataccttgtaccaaaccagaaaaggaagaatccctggtagtctccataggaactattagatggcaaatccaatggacaattctcagttatcattgtacagtatttaatatactctgttgtacctaatctctccttaacttctaaggcttctcttgtctggctcctcctgcccaggatcctccttaggcttctctctgcctctacacctgtgcactagtctcactgcatctacagctgtgtctacagcatgccttactctggcatttccaggcaccatccttggccactgatgttctaactgtacatactttcctcacattggatatttcctcacttcctgggttttaacactgctcatgatgcctatttgtatctctgatttaactctccccactccttggctgccacactaggtgcctcaaatatagcatgatctgcttaagaactcattcttctccctgtgttttctatttttataaatactccagtatccacaattccccaagcagcaaacaggaaatcatatgatacttctctgcatatttattcattaaatcctggtgattctaataactaaatattactagaatttgcttccttctaacactgcttcaattaataatcttttttttttttttttttgagatggagttttgctcttgttgcccaggctggagcacaatggtgcaatctaggctcactgcaatctccacctcccaggttcaagcaattctcctgcctcagcctcccaagtagctgggattacaggcatgcgccaccaggcctggctaattttgtatttttagtacagacggggtttctccatgttggtcaggctggtctcaaactcctggcctcaggtgatccacccacctcagcctcccatagtgctgagattccaagcatgagccaccacatccgacaaccttatcatttttataagtgaattactgaaaaccttctaactgcagcaacctcccaagtattttccttgcttccacttttgtcctctctacttcaacctctatactgccaagtattctttctaaacatttcccccaaagaaattcttccatgatgctccactgccttcatctaaatgacttgagagtgaagatctgtcttaatgtgattctgactacctgtgcagactctctggctttcctctgcagaactctatgcattatccacactgtgctatattcggtgggtgggggaacctgtctgctcctgtgtactctacacatgccattttacctgtgtaggaatgctctccttcccaaccttagtgatataatgtatagttattcttacgtcttagcctagcaaccactttttaagaagagtttcctactctggcaccctttgctttcctttcctctgctcctcaggttcattaaagtgctcattctctccatgcacagtaaccagtattatcagagcaaccatgtcactgcagtgtatacaagtattttctcatctatctccccagtaagtcactcatcaaaggaaaaatagtatgttttccttatttatgaatcttctgaggtctagcccacagaagttgctcattatttaatagatgaatgataatgtactagattataaagttaatccataaggtatcaaaaataatcaaatcactcccaaacattccttagaacggtattacactggagaccaacatactgtcatctctcgacatagttaaacccaggacagttttctatctttggtacaataatatagtcttttttcttttattttctttagagacagggtctcactctgttgcccacgctggagtgcagtagcacaaccatggctcactataaccctgagttcctcggctcaagtgaacttcccacctcagctttcctgattaatttactaggactacaggtacacatcaccatacatggctaacttttttttttttttgacacgggatctcaccatgttcgccaggctggtctcaaactcctggcctcaagcaatcctcctatctcagctgcccaaagcaccagaattacaggcatgagccaccaggcctggccagaaaatagtttctttaaatgaacacctgcagttacaatgcactcaatgacattttatgtaagttttgtattttaaaacaccagagtttatattccatgaagctctatgcatggaaagtaggaagtaacaaggagtaaagaatagcaaatttatatctctcatcctaaggtcactctgtaaatacactcattgagaaattgagaaaaagagcagaataatcacatcatttaaatcaacttgtctatctcagctatatcttattgagcccacttctttgaattcatataaattacatgcaactatgatgaaattccattgtaccaatacgaccgtaagaagttagggctgatttttcacagccaacatttctttcacaattcactttcatcaaaaatttttagtgctccaaatacagtcatgcattacttaacaactgggatatggcctgagaaacttgctggtaggcagatatggtttggctgtgttcccacccaaatctcatcttgaactgtagttcccataatcccaatgtgttgtgggagggatccactggaaggtaattgaatcacagggctggttatctccatgctgttctgctgatagtgagtgagttctgatgaaatctgatggttttataaggggcttttcctcctttgcttagcacttctctctcctgctcctatgtgaagaaggacatgtttgcttcccctttcaccacgattgtaggtttcctaaggtctccccagccctgcagaactgagtcaattaaacctctttcctttataaattacccagtctcgggcagttcacagcagcatgagaacagagaatggactaatacagtacattggtaccacagagagtgtggtgctgctgtaaagatacccaaaaatgtaaaaacagctttccaaccaggtaacaggcaaggctggaacagtatggagggctcaaaagaagacagaaaaacgtgagaaagtttggaacttcctagagacttgttgaatagctttgaccaaaatgctgacagtgatatggacaataaagtccaggctgaggtggcctcagatgaagacgaggaacttactggtaagtggagtaaaggtgactcttgctatgctttaccaaagagaatggtggcattttgcccctgccctagagatctaaggaactttgaacttgaaggagatgatttgggggtatctggtggaggaaatttctaagtggcaaagcattgaagagaacgcggagaagaaaagtttgcaaaatttgcagcctgacaatacaatagaaaagaaaaacccattttgtggggagaaattcaagcccactgcaaaagttggcataagtaacaaggagccagatgttaatcaccaagacaaaggagaaaatgtcttcagggcatttcagagacctttgcagcagcccctcccatcataggcccagaggcctaggagggaaaaacagttttgtgggccagggccagggcccaaaagcagggccccccaacccggctctgtgcagccttgggacatggtgccctgcatcccaactgcttcagtcccagctgtggctaaaagggaccaatgtacagctcaggccattgcttcagagggtgcaagccccaagcattggcagcttccatgtggtgttggtcctgctggtgtgcagaagacaagaattaaggtttgggaacctccacctagatttcagaggatgtgtggaaacacttggatgaccagtctgctgcaggggcagagtcctcatggagaacctctgctagggcactgcagaagggaaatgtggtgttgtagcccccacacagagtccccactggggcactgcctagtggagctgtgagaagagggtcactgtcctccagaccccagaacggtaatctactgacagcttgcacagtgcacctggaaaagccacagacactcaacaccagcccatgaaagtagctgggaggagggatgtaccctacaaagccacaggggtggtgctgctcaaggccataggagcccacctcttgcatcagcatgatctggatgtcagacacggagttaaaggagatcattttggaactttaaggtttaatgactgcactattggactttagacttgcatggggcctacagctcctttgttttggccaatttctcccatttggaatgggtgtatttacccaatgcctgtacccccattgtatctaggaagtaactaacttgcttttgactttacaggctcatagtcagaagagacttgccttgtctcagatgagactttgaacttggacttttgggatattgctgaaatgaattaagactttaagggactgttggaaaggcatgattgtgttttgaaatgtgaggatatgagatttgggaggggccaggagcagaatgatatagtttgtgtccccacccaaatctcatcttgaattgtagctcccaaaatccccatgtcatgggagggccctggtgcgtaatttaattatgggggtggttaccactatgtgattcttgtgattgtcagcgagttctcacaagacggttttataagaagcttttccccctttgctcagcacttcttcctgtcaccatgtgaagaaggacatgtttgcttccccttccaccatgattgtaagtttcctgaggactccccagccctgcggaactgtgagtcaattaaacctctttcctttataaattaccccgtctggggcagttcttttcagcagtgtgagaactaatacaggcaatttcatcattgtgtgaacatcacagagtgacttacacaaacctagacaacatagcctactacacacctgggctatatggtatagcttattgctcctaggctacaaacctgtgcatgtttgtcttatcggactaccattgtgctatccatcattgacttcaacattgctacatggcatgtgacttatattgacaaacacataaaaatcacaagcataatcaagagcatgctaaacccctaactcaaattataattcaaggtaaactttctagagcatagactaagaagaagatgctattgttaattaaaaatcagtgaacaataagcataaattgagtaaaaattgggctagttatttcagcgaggccactaaaggagctcatcttagggcaaaaacttgatataaaaagatttgagtgtgctgccattttggtattatgaacttaccagagcttgcttacaaaaggccagtattctcacgctcaagtccttagatgccatacagatcctaccccactggctgagtcttggtatatgtgtggattgtgctagtgtgaattgtttacgtgtgtttattgtttcccttactttaaacctatttcaaaaatataactactatgtttaatactttttctacagtaattaagttttttgctttttttttttttttttttttttttttgagacggagtcttgctctgtcacccaggctggagttcagtggcgtgatcttggctcactgcaccctccgcctcctgggttcaagcaattctcctgccttagcctcccaaggagctgggattacaagcatccaccaccatgcccggctaattttttgtatttttagtagagatggggtttcatcacgttggccaggctggtctcgaactcctgacctcgtgatctgcccgcctcagcctcccaaagtgctgggattacaggtgtgagccacgacgcctggtcgttttctgcatttttataaggcatccctgggcagcataaatggcaaggtgaacccaaagcaaaaccaaaattaaacaagttgccacaaggataaacacatcaagcatagatttcctccccagtcatgataaatcaagaattgaaataatcctactatactccaagaactaaataactattttaaaatacatctgataatctaaaaaaaaaaaaattgtgaggttaaatatataaaattctatttcctactaaagttattaaatataaataacttttcattttctgtgtgtgtgtgtgtgtgtgtgtgtgtgtgtgtaccaacactgtaattacctacgcatgttaaaattatacaccacatacagggaggccgaggtgggcagatcacttgaggtcaggagttcaagactagcctggccaacatggccaaaccccgtttctactaaaaatacaaaaattagccaagtgtggtggtgcacacctataatcctagctactcgggagactgaggcatgaggactgcttgagcccaggaggcagaagttgcagtgagccgagattgtaccactgtactccagacagggtgatggagtgagaccctagagaatcagttcacttgcttcaaaatattaaataatacttatctatagcccaatccaaaacagaaattctgaagaaaaacaaagatatgctgaacaagaaaaataatgtaggagtattaatgctaaagaaaatcatctggctaatctgaaaatctgcttttagtgtaaaatttttttcaataatcatcaattaattaatctttaagtactccgggtttagaaaagaagtgcagatgccaggtagcgccctctaggaagctttccctcatcccaccaaagtcccaccatctatctatctgttatgatagaagtgataattatttcacacttagtattatttttgtaccctttctccagtagactataaactctttgagggcaagatctatgtttaattcagatttctatgccctagatatctaccagagtgccttccacaaagacttaatacatatgtatttttgaaataaaaagatatcctctcctaaatttacactttcagcttttttaacaaaataaactgtatactacatcaatttctatttttcttcctactcctcagtagttcctattttaccccttttagctaacttctcttatccctaatccctgagggaatgttcatccatttgttcacttattcattcaaataatccaatgaatatttgtgaagcaccaactatgtacaagcagtgaataagatgctagggttataccgtgaacaagcctcttagaaagctaacactttgatgggaaagacagacaagtaaataggtaattgtaaaacaatgtgaaaattgttactatagacatgaacacacaataccgtttaaaaaagagagacatttaatagtgtttttccaagtttttgtctgcggactgttttatctgtcttactgtttcccttggtcatccattcatccaaccatttatttgtctgtctactttcaactattagataatacatgtatgtggcacaaaacacaaaagatactgaaaaatacataaatgaaaagtcttcctcctatcttatccctggccactcagtttattttcccaaagacaagcactaatacccagtgcataatttcagagatactcgatcaatagacaaacatatatacacatgtttacggtctaattttattttaacacaacagaagtatgctttatactcgtctgcacctagtttttttaacttctattaatgcccatattgggctgtctcattctttcagatggatatagagattccactgcatgaatgtaactttatttaagcagactccttacgaatgctcatttaaaatgctacaatgctgcaatgagtatacttatctatatatcattctgtggtgcatctgtacgtctgtaggataaattcttagaaatgaaattgctgagtccaagtataagcgcattttaaattttgatagatactgatgtaagaggtttcatcaatttcatttccacccccataacttaaattataatctttatgggaatggctgccaaaactgcatccacagttttgactctttatccactctccatcatagttccacacatacattactttaaaagcttacgaaaaactgtttcaaaaccaaatttataaggttaacatgttcttcataattgcactgtatctgctaaggctcccaaattccaaccaaaaatcacttttcattgtacctttttgtttctaccaagatctaattaattggtcattaagatgtaacaatatggccaggtgtgatggctcacgtctgtaatcccagccctgtgaaaggctgacgtgggtgcatcacttgaggccaacagttcaagaccagcctaggcaacatggcaaaaccctatctctacaaaaaaatacagaaattagccaggcatggtgatgcatgcctgtagtcccagttacacaggaggctgtgatgggaggatagcttaagcttaggaggtggaagttgcagtgagcagagatggcaccactacaatccagcctgaatgacagagccagaccccatctcaaaaaaaaaaagatgtaccaatcctacagttccacaacatccattttcttcgtattttctcagacatcttactgcaagggcccagttctgtattcctgggttattattatttaattatcttgtcctatcatccaccagtgattctgcccatcccatcctctctgcctgaaacaacttcttacatcaattccctgggtgaaatctcattaagcctactctaagtgctagatcatccataaagcattttcttttatgactttattagaagttaggtctttcactatgcattctaatttgtaatacactaagggaagttatatactccttcacagcaaggataatatcttaacacattttcataaacccatactgcctaggcactcaaaatgtgtttaccaaattaatgaattaagttttgggttttgatttttttttttttatttgagaccaggtaatgctctgtcacccaggctgaagtgcagtggcatgaccatggctcactgcagccttgacctcccaggctcaagtgatcctcccgcctcagctcctcagtagctgggagtacaggagctgggtgtgtgccaccatgtccaggtaatttttttattttttgtagagacaagcttccactatgttgcccaggccggtctcaaactcctgagctcaagtgatccacccgcctcagcctccccaactgctgggattacaagtctgagccaccatgcaagccctgaatgaatgaagttttgcaacaaacgaattcctgcaaatcagataattctacaggaaaaaaattccataaaggatatttaattatttattttggaaaataagaatattttaagttcatgagacacaaacaagaccctatttaataattaaatttatttcagaaagcccacaataaaaatatttccagttagcttttccagtaaatttacttttccctcacattgactgtgatcaaaaccaaggaagagaaaggagaaggaataaaggaatgagtgaaatgtgctaataaaaatattaaatttatctccaaaatattgtcagtctcttaaatatagtcatggtaggcccggcgtggtggctcacgcctgtaatcccagcactttgggaggctgaggcagatggatcacaaggtcaggagatcgagaccatcctggccaacatggtgaaaccccatctctactaaaaatacaaaaattagctgggtgtggcggtgcgcgcctgtagtctcaactactcggggggctgaggcaggagaatcgcttgaacccgggaggcagaggtggtagtaagcttagattgtgctgctgcactccagcctgacgacagagcgaaactccatctcaaaaaaaaaaaaaaaaaaattatatatatatatatatatacacacacacacacacacacacacatatatacccacccatatatatacatatacatatatacatacatatatatacacatatacacatatatatacaccctcatatatacatacacacacacacatatatatatatatagtcatagtactctactataaagaagagaaaactcagccataatgtgcccatggactattgttccactgagtttagaatgggtaaaataacttttgaccatgttcacagcctacttgaaaagaaactttgtgaaacaataaatcttgtatttctggttttcaaaatttaataacatgatttcaaaaatcatacttctgttaaaactttttacatttaaaaacacaggaaaaagaagaatatgattatgctttccaacatataaatgtagttatataaaaacaatcattacatctcatcagaaataatttcgctcccatttgttcaatagtattaagagctacataaattcctatcaagaaatggagaactgctatattgtaacttgtattttaagtaatgtttttaaaataatgaaaatactaccatgcaaatactggatttacttcttgactcacctcgcccccattaacatattccatcacaaaacacaaacggtcttttgtctggaaggaatatttcaaggacttgaaataaaaaaaagaaaaaatgttacattataatcctgtattcttataattataatagtactaaaaatagaacacatagaaatagtaagcatgaaagatgaaaagaattgttattgtttaagagtttatttactacttaaaagtgcttaagagtttatgagaaacataaaacaaatgtttagttcacaataggtattattacaagaaaaactaaaattaaaatttcaagtaaaagtaaacttaattgcaacaagcacttctcaatctaatttgccattgatttgaagctgcattagtactcaaggttctcatccatgcaacctcacagcgtggccaacaaattacactagttgaagttccttaggaatgtagctacggttgttacactcaggtttctaatacaatgacaacatcactttttgcatattgagtgcacaacagaacccaacctaacagagttggtttatataattttgtaggttatatataggttattaaaaaatacccaaatgctatcttattacactagacaataaacacaccaaaaaaggtagcaaagtaagtctaggtatctactgacagctctgaaaatgtctatttcagatattccaaacagtgtaaagggttccactttggaaagtctagctattatttttcatctcaatatagttcattggaaccaagaaaatacagaaactttaccaattatccctatattacaaggaatctaagaacagaactaaaaaatccagtttctttcaagacaactaagttgtaggcataccatataatcagtttatactttgtctagtgaaaaaaacgtagcatggcttatcccacctctaatgtatttagcattcccatatttcttaaagtactctatccctcaaagaagtctcatttctataaaatatattcgataaacatttctgccttccatatttgaagaaatgcttctgatcattaagatatttatcagaagccaataaaacaaacataaaatctttacatttaagaaatttttaaaaatcagccatttcctcaatagtctccttaaaatgccagaggtaatgtattaactctatggtttgtttttgtttttaatggcaagagattcatgggagaaaaaaaattctcaaaaaagtaataaatgcataatgggaggaattatcaatgcatacacactgtaaaaatccatacattctaataagttataagaaatttgacttacgttctttccacaaagaaaatgagatatctaaatgaatagtatttttcacaatttaatttctaacataaaattccttaaatttcaaatgttacgattataacatctgtcctctagtcacttactgttaaaaagggatgtctagtgttctttaatactctgctttcagttagagtgtgtgccacttcatcctacaaaagaaaaaaagcaaaccttcaatatatgttttgagcactgataataataatttcactatttctctaaaattggaagaggttaagcccagagattgaaaaggattttaaaacacagtggcatgcttcctttaccactcagcattctctccaccaaaatacaaaaaaactcaaattaatgatttaattcagatgattgtataagttcatataaattcactcatacttaatcaaagtatatcaataatgatacaaaaatcagtcagaaaattatcagggacacagaaaattaaatattgagctttcctccttgaagggaacaatttatcaactaatatttctgcatgaggtaatttaatatctccatgtttgtaatacattttattcagggggatgaaaggatatatttcccaataaatatcaaagaatttaaaagtctcctactttaaataaattagttattagaacacagaatacacatgcaatatttagttctaaattacacattttagaaatagaaaggaacagagtataaaaatatatacctttctgcttgtggctttttaatttgcgtcttaatttttaaagccaagttcttgctctgttgcccaggatagagtacagtggtacaatcacagctcactgtaaccttgaactcctggactcaagcattactcctgcctcagcctcctgagtagctgggattacagatgtgaggcaccatgcccagccttatatgcttccttatttatttttttagagatagggtcttgctatgttgcccaggctgagctcaaactcctgaggatcaaggaatcctcccgcttcagactcccaagtagcagagactacaggttgttttttttcctttggttgggggcgtgggtgttacacatttttttttatttcaataggtttttggggagcaggtggtgttacatgaataagttctttagtggtgatttctgagattttggtgcacccatcacctgagaagcatatgctgtacccaatgtgtagtcttttatgcctcaccctgcttccatcctttcccccaactccccaaagtccactgtatccttcttttgcttttttgtcctcatagcttagctccagagactacaggtttaatgtgcttttcttaaaaaaaaaaaaaaaaaaaaaaaaagctcacaaccctcctactgtaggtgatcattttaaaatgtaagtatatttcaaaccaaaaataaactaagaatgttttccccaactttgggcataaatctcatattgatatcaaaagcaaactagtgttttcttcaacatatggagaactggagataatgtttcatatttcaaaagtaacactatcttaaagaagaaacgaaaggaagacaactgctgaaacgaacacagcatctctgttcttcacttctggcaagatcttaaataaagcccttgctgaatcaatttcttaacactgtcagaaaatcaaaattagatggaagaaagacatgaaaagcaaaacatcaggacactgcattatatttgttatctttataaaaatatttgaccttaaactcgaaagataatgataactagattaatcaaagaagctaagatcccacaaccattcaaagaaggtaagatcaattgtgtctgaacagaaagtataattaacaacgagtgaaggaaagcataaacatgaaatcatctcagtcttatttgttttataggagtcagttttaagtgctcaatttgaaagccaatgtcatatcgtactatagttcctaagttaattagaatagcaaacattgtaaaacaaaataaatcagaagcagaaatgacaccagaacttactgatttccatatacactgtgcctaacataatggtaagcatacagcagatacctaataaatgtctattgaactgaattgtgtatcataggaaagaattccaagatgtcaagtgtgcaagagttcattcatccatccacccacccacccacccaccgacttcttcaacacatatgcaacaagtatcttctgggtattcgtctgcacatcagagacaggacactgaacaaatagacaaaattctctgctctcatggagctttagttctacttacatggtgatcagtgttaatgggaaaaaccagagaaggggatactacagttaatgagcatcacagagggaatatgaaatacataattaagcattatacaagtggctattttgtgatatactgaaccaagtccattcacttaaaaaaaaaactgctgatgtgcactcactaattggtaagaacagtgctggtataaggtaacttaataaaaaaaataagatcccattgctcacagagttcataggctagtggaaaacacaaacaagtaaattatccaacttaaataattactctttctgataagtgatattaaggaaaaagtggaggttatccactattgtcaacggggctgtaagggagaaccaatgctattggtagagtgtaagttgggtattgtgatggtgtgggacatagagaaagtgatggggtgggggtgacatgtttgtgaaagtctactcacgttcttctaagaaggatcaattaggaaagcattacataaccccaagagagaagtgaggatggcttggactactatggtggcagcggaaaaagaaaaaggggatagttctgagatataaagttaacagtgctaatataaaagttacatgcctccaacatgagagtgaatcacagacattttaataggcagttcagaaagaaattcacagaagataacatctacctgttgtggtttaagatgttaagtgatctgggtcaagaaattaggaaaagactagagaaaagtatgtatgaaatttatttagaaatagaaaagatattctagtgctttgaatattttcagtggggtattacattctattttgttaaaacaggcttatcacgcataatagttatttttctaaatcacttagtaactttcatgagggaagacttttctaccccctaaatttgtaatctgaccacatccaaggaaccaagtaaagacgtatggaggcaaaagcaaaaacagtatttgttatgagaatggaactggaatgaacaccatgtacataccaaaatgtattttctaacatattttacagctgatcagattagaatttcttcccattaatgcatatttaatggtactgtatttcacatactaattagtttctgctatgaagataaggtatgcgcaagctaaaaagtaaacacagatgctaataatttttaattacagttaaaagcaacatgtcaaaacaaaaagttaaaaataacagtagtaaaacagtgactaaaacaatgtgatgccttttaaaaaatccatctgttgatcataattatgaagagttctagaaatgcttggggatacaatgtatttttttcatggaaaagcttttgaaatacaaatttacatatatttatccatggtaaaatagtaaataatgaacttttaaatctaatttctttcatagaagaattagggggaatgggattttatttcttcaggcagaagaatagtctttttaatattttattttcccaatcctctccaatttatcattcaccctctattacacacgatctaaagttctcctttcatttgaccctctcgatgttttgtggtaattaggttatttgagggaatgaggtgtaggagagggcaaacaagaggagaaaaagaaaatttctacccttaatgatcaagaacaccatgagtgtcatctcctttaatccctgcaccaactgatcccacatctaagttcaatagtaaaggtcatttctacttcacaaaactgcctcccatcttcaaacaacctactatctacttcactaggtactctgctcacattattttctccaaattgaccacaagtctagttgaaatcaagacacattccgtctaaaccatttcctccatccacccagagctataaatgagacctagaggaagacacgaatcaggtgggagaaacgggaagagggtagagaaatgttactttggcacatgttttttcgatacataatagttgtatacattttcggggtacatgtgttgttttgacacattccatatgtgtaatgaccaaattagggtaatggggatattcatcacctccaacctttaacttttctttatgctggagacattcaaattcttctcttccagctattttaaaatacacagtaggtggttgttaactatagtcgccctactgaactatctaacactaggtcttattacaactgtacttctgtacctattaatcaactccatctccccatccccctaccattcccagcctctaggaacaaccaatctactgtctatcttgatgcaatcccgttttttagctcccacataagaacaaaaatgtgcaatatttgtctttctgtgcctggcttatttcacttaacataatgggttccatttccatcaatgttgctgcagataacgtgatttcattctttttatggctaagtaatattccactctgtacatatatcgcatttatcctttcattcattgatgggcacttaggttgattacatattttggctgttgtgaatagtgctgcaataaacctaagggtgtagatgtctccccgatatgatgatttcctttgttttggatatatatatggtagttctatttttagtttttgaggaactttcatatggttttctatagtggttatactgatttacattcccaccaacagcataggagagttccctttagcatctgtgatttttttgtttttttgataaaagtcattgtaactggggtgagatgatgatatggttaggtatccacccaagtctcatcttgaattgtaatccccataatccctacatgtcgagggagagacctgctgggaggtgactgggatcagggggcagtgtcccccacgctgttcttgtgatagtgagtgaattcttaggagctctgatggttttataagtgtctgacagttcctcttcacacactcgccctttcttcgcctgataccacacaagacatgcctcttcccccttccatcatgactgtaagtttcctgaagcctccccagccatgcagaactgtgagtcaattaaacctcttttctttataaattacccaatcttgggcagttctttataccagtgtgagaatgaactaatacagatgatatcacattgtggttttgatttgcatttccctgatgagtagtgatatgacacacttttacaaattaaacaatgattaccagtgattattatttacttttccactgtctcaacaagccatatgttagcaatgtatacttttttttttcctgccagaggagacatgtcacacttatcaagctctaaattttgggttctaacttttgtttcttgaaaacttgagcactggcccagataatgacttctaatacttcttccattctccagctgtcagactgtcttctgttccttgatttctattcctttttttgaagatttctcaccttgatggagatgaaagcaccgttgttctctgttaactacaaacattattgcgcctttctcgagtattgtgtttgatactttgttcttgatgctccagttccaaatattccttagatgaaggccaaatgaactcctttgacttccatcatgatataatcactttggactccagtctttcttctgcctctctcatacgcggtattgggacaagttcatctctaccctcttaactctatatttcacatctaaagataaatttacacaaacatattgactaacaccattggaatctccctaaaaactcagctgaatcttctgaggcctctttcatccatcgctacttaggtcactcttcaatttctcaggatggttgtttcaaatctttcccaggccttcttccttgcctggtaggtatacttaaatgtacacactaacccttacctagtcaagctactaagctaagactagaacccaggtctgtgctgacttccaagcacaggagcttttcatttatttgtctctctttatctcagcctcactcgttcacactttcaaaatgcgatcttacttcctactcagaagagaagccataaacgtaacatttaacacatttgatcactccttcctcctgaaaacgtgttcttcttttgggtcccaggacatcctaatctcttcatcttcctcctcttcagtggttgtctttccgcagtctcatttgctgcttcctttgctctgaaacccttattctgtaagcatctccaggactcagtcctcagaattctcttcactgggtacactcttcctttggtaaactcattcagactatggctctaatacaggatatatgctgacagacttccaaatttatacctcaaatctagacttctttcctaaacttaaaaaatgcctatttggcatggatgtataatcagtgacataaactggagtatctaacaaaaatagcaaatttgacatatctaaaacctaattccaaatctccccttgaaaagtttctcctgcagtcaacttcaatgtagtgaatggcaataccatgctttcagttgcttagaccaaacatcttaacaatgatctccaactccttttttttcccactcatactctacattcaatctgtcaagcaatcctgttggttcttcatcaaaatacacccaaggtctcattatcatcactacctccattgctactaccctagtacaagccactatcatcaattatctagattactgctgcaattagcaaactatctgcttccaatccacagtctattgtcaacactgcagccaaagtgatactgaaaactagactgtgtaactacacggcataaaaatttccaaaggcttcccacttcattcacagtaaaagccaatatccttacaaacatcctacaccattcttgttccacaccatgctagactcctagctattcaaagaatgtgttagaatgtgctaagtaagctccctcctcagggccttctcaattgctatttccccttgctggaacattcttccttcaaaatatctaaaggacttgcttcctgatctccttcaaatgcttgctgaaatttcacctttcagtgaggccttccatagtcatgctatttaaaactgcattaagtccccaaaatcgctaccatcattattccttatttccctactccacttttctctgtaagtatggattagtttattacatactctatggtttatttattatgtgtattatttattctctaattgctgacttgaataaaatttcccaaaggagaggagtttgtcagttttattcgttcaaatggtcccagtgcctagagcagtacctagcaaataattaggtgttcgacatatatttattgaaataatgagtgaatgaactagtaaataacgaataaccttggtgcatgctgctgaagaatagaagctacacgaactacatgaaataactctagaacataaatcactgaaatcatactcccaatagaacaatgacagttgatgaaggtatagcagatcaaaccattatctgcttcctacaataaaccacaatcgttgatgcaatgtttaatacagaggttcaaaagaatatgaaagaagagaacaaagtaactggctgatcacgttaagagatttcagttaagatccaccagtaagaacttaagagtccaaggaaaaagagatgccagtaatcaagcaaacgcattgggttattttaatggacttacgtgcagaaaaagggtaacacatcaggcctgggttgcccaaactctacacattcccaaaaaagtcagtcttcagaactggcgccgttggccaactcctgggaaatgaattctgagcctctgaaatattctgcctggtcagagtatttttgtatgctggagatcttgggccacatggtaccagtttgactagatagtttatgcaaacaacaggatgcatgattaatacttcgtgcctgattttgctctgagaggttggaatctgagcatctcagggcagtcatgaaggtactgcttgcctatgtgactgacttccaataaaaaccctggacaccaaggctcaggtaagcttctttagttgacaacacttcactactgggagaattaaaattaaccatcacagatgcacttatgtgtcaacttgactggattaaggaatacctagagaactggtaaagcattactaatagctgtttctgtgtttccagaggagactggaatgtgaattgatggactgagtgagaaatattcacccacaatgtgagcagacaccatccaatcaactaagagcccaaataggacccaaaaaagcaaagaaaaggcactctcctggaatggggacactcctcttctcctgtccttggacatcagaactctaggctctctgacatttggactccaggctttataccagcaactccctagtttcccaccaaaacccaggttcctggcccttagcctcagactaagaattacaccatcagcttcccagggaacttggacggagatacgttaccagcatcccaaggtctccagcttccagatggcctgtcttgggaattttcaacctccataatcacatgagccaatttcccagtgaattctctctcatatatgtatatgtatccgattgtgtctgtctctctggagatccttgatttcaccacatcatccatgtgactccactggaagaagataccttaaagcttgcacttggtttctccaggattttgctctatgtggttttccctttgctgattttaatctgtacttttcactatcataaacaataaccatgagtcttttctgagtcttgtgagtcatgactcactgagcctgagagtggtcttagggacagctgacacagttgccatcataagtaggactcattaaagcatggcaaaaacattgtttcaaaaaaggaagaatgacagggcagacaatgacaaactctgatgcctaaatgggtatacagtcaccaatggcatgagacggcagctgtactgtgctgttactacatatagaagttgtcaatggaatttagaaatgacagaccaaaatctcaaggacttagatcactggatacataaagaaatgcaaaatgatgagaaacaagctaaatacacaatccactggtaacgtgtacttttttccccacatgtaagatttttattccaatttgatttgcatttcaaaggaaattataaaatgtatccactttttttaagacaaaaatttaattataaaacatgataaacttccaggttaaaattaggctaactgcttggaataacaaactcttaaatcaccattttccacctccacaccaagaataaccatttaatcaaccatactgtaacagcaggatagcactgagacttgagtaaagaggaaaactaaagagctcttccagctccaaatcatgaacatttttatgccttcttatagtggtgaacggcaaccacatcatcaccaaaagtaagtcataaccatttcaccatacttaatttctcttataaaatatgtttctttgtcatcccatttctgtatgtgaatgagtttgtctctgtccagactaacaacaaacttgcagtttctgtcatctgtagtggtttcatcaaactcttctcccagatggaaactaacctctgtgttcttgaacatactttgaatcctgatcaccaccttttgtcttcttcttgactgataatcactcttggtttgtccacatttcccacctgcctagtgacaaagcccatccctagagccttcatgtactcatcaaagttctgtcggtcagcttccaggtattacagaaagcctcctccacccttgccctttccccactttagagacagaagtgaggagctgctggtcttattgccactgcagtttgtgtttttttttttttttttttttttttgagagggagtctcgctgtgtctcccaggctggagtacagtggcatgatctcagatcactgcaacctctgcctcctgggttccagtgattctcctgcctcagcccctcaagtagctgggattacagacgcatgccaccaagccaagctaattttctgtatttttagtggagacagggtttcaccatgttggtcaggctggtctcaaactcctggcctcaagtgatctgcccgacttggcctcccaacgtactgggattaccaatgtgagccactgcgcctggcccagtctgctgtattttaaaacagctaaaatgaaagtaagagagagtgttaaggaaatcctgatgctcaaaaagcttggattttggttagcttgagctatggctgttagcctccaggataaacccaatggaaaattatgctgaaaaaaacagacagtatatctatggcctttgaccaccaggaacattgtccaaatggtgggtgacaaaaccaagacagtactggaagcaggggttatgtgtgaaggagttatcttgccttgtgaactggtattcatcgggttcctgaaaaacatttaagaaaatagattgtgagagtgactaacttgggagcagtatctttgattctgaatgttgcagaatgaagaagtctgcttggggttgatgcaggaaccttattactgaacaatcatggattgttgtacatgatccaaacacacaatagattgttcctaaagggacagctagtctggtggactgggtaaaagccactgtaaaatttgtttaccctgaaaagggaaatggtccttcccctcctttaaatgccaagtggcactcctccatagatgacatagctggtaagctgcatatgcaaaccatgctggattaacttcatggtcatcaggatgtttgttcatccttaatatgccctttaaatcatggtaaatactgtgactgaaggggccccgctaggcaggcatctgatataactgctgcaaaatctatcaatggtccaagaaatgtgtcagatttgttgtctcagcttcttaatatgggtcttacagatgctaagaaaataagactgaatcacaagtgaatgggtaacacaaaacagatagtcaacgaagtcccaagcaggatgaagttttaaacggttactaagagatgggatgaataaaatggacactgatgttaacacaaaggtcttaatgctgcactatcagaagttaggtttaccaatgggagcgcctcttagtcccccaacactgaagggccctaaacaaacactctatgcaccctaatttcaaagaatgcaccaagctgggaagcaaaaatgacaatgaagaacctcagttcaaatcatcagaggtgatgggctaccaaattaatcaggatgaggactgacacagaaccagggctttcttttaactaatctcctagtagggactgaaggccatatgcacacctgtaggtacaatagaaggtaaaaaagaaaccttccaggggttcctgacatagaattcagtgcctctgattccaaaacctattggtaaaatcctagcagaggcaataactagaaagacaggatatgaggatgaaatggctgataggattaaattaaaatttggatgaaaattagtatgtttgaatgaatcttggaagtacttgcatccacattacctgaatatgttttggggaaggatatgatgtttgaccagggaaaacttcagctactatactgcagaaagcttgttagttttcccttcagtcagaacaggctaaatgagaatctgtgcaacttccccagctcacataggttgttaatttgaaacagtatcatggtggaccaaaagagatttagcacatgaattaatgacatgttcgacactggagtgctgttaccaacaagttctgtgtcgtgcatgaaaaaggtgaattattcatgaaaactcacagcagataatcaagacttgaataatatagtatcatctacagcatcagcagtctctgacatggtttcagaagttctcaaaataaaacaatctaaaagagacatactcagccagacatagtggctcacacctgtaatcccagcactttgggaggccaaggcaggaggatcacttgagtccaggagtgtaagactagcctggacaacatagtgagaccctgtttcaattaaaaaaaaaaaaagagagagagacatactgattgatcttgaaaatacttttttcttggtcccaatctcaggaaaaaaacaactgcactttgccttctagtgggaatgatcccaatttatacttactgcagtgctgcaggtttatctgcatttatcagcttaccattataatttgtttcgaagggattctgacttgatacaggtccagaatacaataatatactacactgatgacattatgacggtatcagaaacctaagaacaagctagggctaacttgaaaatagtggtggctcacaggaataccacaggctggaggataaatccagcaaataccccagggtctaaccaaactgtgaaattcttacgaataacctgggcaggaaccacccataacattctacaggcaactaaaattaaattgctcttattacataaccatgaaagtaaacaagcagcattcactgcagctggtttgcttgagttttgcgaagaaaaattctgtatctggggactagtgctaaatccaatccgtaaaactacctgaaaggacacatatgaatggaaacctaaacaacagcaggctattatctaagttgcagtggctcaattaatgcctttgggtccttacgatatacactcagatatgattttagaagtatctgcaactcagactggagcttatggcaaaaagcccatgaatgctgtccagcagtaaccactgggaccatgggccagacaagaaagtatagaacacatcattagagagacgattattggtttgctcccgggcattaactgcaactgtctttatgactgaaggacataacataatcctaaaacctaaaatatccatgtcttgggtaatgtcagagaaacactctaacgagtaccaataacaaaatgaaaatggcttaacgggaatgtgctgaggaatgcaagaagacacttaccatattcaatagaagaaaacctttttttttttgagacagggtctcactttgtgtcaaccaggctgaatacagtgggggcaatcacaactcactgcagccttgacctcccaggctcaagcaatcccgcatctcagccaaatgagtagctggtatcaccagaggcatgccaccacacctggctaatttttattttttgtagagatgggagtctcactatgttgcccaggctgagtctgagtctgaactcctggactcatgcgattctcctgccttggcctcccaaagtgttgagactgcagccatgagtcatcacgcttggcctcctcttttcttccagatcaactttggaaccatctgtaaagctaccagatcctattgccacatcctactgttcaaatgctagtgtcttacaaagagctctcactgaccaccaaaaagtggcttgttttacagatgatagcagttcaaaggtaatcagccagcatcctgtttggaaggctgtcacactataactgactgatgtgaaactgatgaaagaacaacaaatcagctcaaagggctcaattgtacattgttctccttgcaatgatggatgaactaaacaaacataaccttcatgtgtggatgtacacccatgaatgggctgtggccatttgcctggccatatggtcaggctgacaggcagtgaaaaactagactattaaatggatgtgccaggcatggtggctcacgcctgtaatcccagcactttgggaggccgaggcaggtggatcacctgaggtcaggagtttgagaccagcctgaccaacatggtgaaaccccgcctctactaaatacaaaaagttagccaggtgtggtggtgaatgcctgtaatctcagctacttgggaggctgaggcaggagaatctcttgcacctgggaggcagaggttgcagtgagctgagtttgcaccattgcattccagcctgggcaacaagagcaaaactccatctcaaaaataaataagtaaacaaaataaataataaatggatgggtgattaatgaggcatggctctatgagaatcattatgggaatttaaggggtgaattaaagtaggacatgttgatggtcatcaaaagaacttctttcaggatcaggagatgactggaaccagcaagtggatgtcccagcatgcttgtttgaggtggctatctgggtccccaaaataagtagatatgggagatattggccgggcacagtggctcatgcctgtaatcccagcactttgggaggccaaggcgggtggatcatgaggtcaggagaccgagaccatcctggctaacatggtgaaaccccgtctctactaaaagtacaaaaaattagccaggcgtggtggtgggcacctgtagtcccagctactcaggaggctgaggcaggagaatggcgtgaacccaggaggcggggcttgcagtgagccgagatcgcgccactgcactccagcctgggcgactgagtgagactttgtctccaaaaataaaaataaaaaagatatgggagatatgcagcaatgcagacagagatgggctggccattgatatattcctcttgtaccctctgatgcacaaaattccagaaagagccatcctgtctgccagaaagggagaaagagactgcagatgactatggcatatattccccagaaaaaagtccccccactcccatatatagttggcaaatacactacactgagctactgccactatccccaggaagctataaatggtaattcttggaaatagacgtttacagtggattgggctttgcatacccaatggtagatacaaaagctcaaaataccgtaagatgactggaacagaaggtactgcacccccaccaagttacatgtcttcagaccaaagaatgtactttatagcccatacgccatactttacagccaatatccccagaagtctcaaccagtgcagtatcaagtcaaagtccaaaatctcatttaaatatcatcagctcaaaagtcccaagtgttataacccaaatcaggaatgggtgagactctatgcataatccaccctggggcaaaattcctctaaatctgtggacctctcacactagaaaacaagttatctgcttccaaaatacaatggtagaaaaggcctaggacagatattcccactcagaaagggagaaattggaagaaataaaaacatcactgattccaagcaagttctaaacccagcaagggaaattcgatttcaaggtctgtaactaatcctcagtaatttgtatttctgtcctctaggcccatggtggctccatcaacctctgcctttgcaaccctggtggctccatcaccctgtctctggcctccaattcattcttgcttttttttaaaaaaaaaattataacatgctttcagctgacatccatcaactataccatttcttttacactgacagggtttataacattttcagtctgttctgtaactatacttaagtcttcggtgctttgtctattgataaatcctaaaaactgaacgccaatttggtgtttccaatggtgtaagtaaatgaatattattcatgggacaatcaaatagtatggtcagacctgtaatgaaggaaaggttactctacatcaatagacctgggcttctcaagaaccaatgtttcatgtctcaaccaaatagcctcttttttttttttccatacaggcatacgtcaggttttgttccagaccaccacaacaaaagtattgcaataaaacgagtcacactaactttgtggtgtcccagtgcatataagttatgtttacactgcactatactgtagtctattaagtgtgtaacagcactatgtctaaagaaatgtatataccttaatttaaaaatacttgactgccaaaaaaggctaagggtcatctgagccctcagcaagttgttatctttttgctggcagaaggtcttctcttgacgttgatggctgctgagtgatcagggtggcagttgccaaaggtgagagtgggtgtggcaatttctttcttttttttgagacgaagtcttgctctggcacccaggctggagtgcagtggcacgatcttggtattcaagcaattctcatgcctcagcctcccaagtagctgggattacaggcacctgccatcacacccaactaatttttgtatttttagtagagacaaggtttcaccatattggccaggctggtcttgaacccctgacctcaagcgatctgcctgctttggcctcccaaagtgctgggattacagacatgagccaccatgcccagcgtggcaatttcttaaaatgagaaaacaatgaagtttcccatattgactttctcttccaagaaaggctttctctttcgcatgccatgctgcttatccacagcacaactttcttcacaatcggagtcaatcctttcacaacctgccactgctttatcaactaagtttatgtaattttctaaatcctttgctgttatttcagcaatgttcatggcatcttctcaaagagtagatcctatctcaagaaaccagtttctttgctcatccataagaagcaaatcctcatttgttcatgtttcatcatgggcctgataaaatttagtcctatcttcaggctccactgctaattctagttctcttgctatttctaccacctctgcagttatttcctccactggagtcttgaacccctcaaactcatccatgaagattggaatcaacttcttacacactcctattaatgttgatattctgacctccttccatgaacattcatgaagactgaatgtttttcaaggcatctagaatggtgaatctttcccaaaaggttttcaattaagtttccttggatctatcagcagaggaattactatctatggcagtaattactgtctattacaaaatgtatttcttaaataataagacttgaaagttgaaataatgggctgcagaatggacgttgataatgagctgcagaactgacgctgggttagcaggcatgaaaacaacattcatctccttgtatatctccatcagagcttttgtatatctggtgcattgtcaatgagcagtaatatttaaaaagtaatctttttttctgaggaggtctccacagcgggcctaaaatattcagtaaaacatactgtaagcagatgtgcttgtcatccaagctttgttgctttactgataagagaacaggcagtgtagagttaccataattcttaagggccctaggatttttgaaatggtaaaggagcaatggcttcaacttaaagtcaccaactgcatagccactactgagagagtcaatctgcccttggaagctttagagccaggcaatgacttctcctttctaaggaagtcctaagttcaactacatggaaaatctgtggtttcgtgtagtcatcttcaccaattatttagctagatatctggataacttgctgcagcttctgtgtcagcacttgtggtttcacattgcacttttaggctatagagatggtgtctttccttaaacctcacacgccaacctttcctagcttccaactgttcttctgcagcttccttacttctctcacccttcacagaattgggagaattaaggccttgctctggattaggctttggcttaagggaatgttgcagctggtttgaacttctatcaagaccactcgaactttttccatattagcaatgagtctgttttgcttgcttatcatcaaatacaagggcaccctaataagattatcgaagatttctcatcagaaacattgaaggccagaaggcaattggttgatacattcaaagtgctgaaggaaaaaaactaaagcaagaatccagcaaaactatctttcaaaaaatgagggaggtatcaagacatttctaggtaaacagaaactgagggagttcattagcactggacctgtcatacaagaaaagctatagtgagttatattaaacccttcaggtttaaatataaggacattagacagtcacttaaagtcagatgaagaattaaagatctggtaaagctaaatacacaaaaaaatataaaagctagtattactgtaagtttgtgttgtaataccactttttgctttctacatgattaaagagactcatacattaaaaaattagtagtcttgtttttggacacacaatgcataaagatgcaatttaaagacaccaacaattgaaaggagtaaggacagaattgtaaagaagtggagtttttgagggttattaaagttaaggtggtataaatttaaattacagtactataacttcaggatattaaatataacctatacaaagaaaatagctatagaatatacacaacaggaaatgacaagagaattaaaatgtttcactaaaaaatcaattaaacacaaaagaaggcatttatgtagaaaaggagggacaaaaagcaatgaggcatatagaaaataaatagcaaaaggaccgaagtcagtccttatcacgactcactttaaacataaatggactaaactctccaatcaaaagaaagagattgggaaagtcgattaaacaaacaataagaatgatccaattccatgctgtctccaaaagccacaaactgggtaaaagtgaaagagaaaaaattattacatgaaaatatagcagttccccttattagtggaggatatgttttgagaccctggtatttgcctaaaaccatggatagtaccaaactctataaagtcattccttgatatccatgggggattggtttcaaaatccccctgcagataacaaaatccacaaatgctcacttccctagtatcaaatagcatagtatttgcatataatctatgcacatcttcccatatactttaaatcatctctagattagttatcatatcagatataatgtaaatgttatgtaaatagctgttacaatacattggttttttaatttttaatatttttattcttgtattattatttttgagtattttaaatccacattggttgaatccatggatatggaatacagagagccaactgcatatactgtgtttttttcctacacatactacctaagataaagtttaatttgtaaattaggcacatcctttataaatggatattaaaagtagattaacagctactattaaaagtaaattaacaacaataataaaatagaaaacttataacaatatattgtgatacaagttattgtgatgcatatggtctctctctcaaaatatcttattttactatactcatctatatttaggctgtggttgattgggggtaactcaaaccatgaaaagcaaaactgcagctaaagggggtactgccatagtaaccaaaagagaaaaggggtggctatattaatatcagacaaaatagactttaaatgaaaaggccagaaaacaccaaaaaaagatattattaataaaagttaatacagcaagatataacaataataaacacttacatacctaataacaagaccatcaaaatatatgaggcaaaaattgaaagaactgcagaaagcaatgaccattttacaataatagttggagatttcaataccctacactctcaatgatgaatacaacaaccagaaagaaagaagtaaggcaacggaagacttcgacaactcaataaagcaactaaatctaagacatatacacaaaatgctctattaaatatacacaaaatactctacctaacaacagaatctacagtcttttcaagtgcataggggacgttctccaggatagatcatatgttggattacaaataaagtctcaataaactttaaaagacaaatacaaagtatcttctccaactacaacatgaagttagaatataaagaaaacaagaaaattcccaaatttgtagaaattaaacaacagacacaatcaatgacaaaggaaattagaaatactttgagatgaatgaaaacaaaaatacgacagactaaaatttatgggatgccacaaaaacagtgctaagggagaaatttaaagccataaatgcttatactaaataagagagattgcaaatcaacaatctaactttataacttaaggaactaggaaaaaaataaattaacccaaagcaagcagtaggaaaaaaaaataaagattaaagcaaagacagataaaacaaagaaaagtcaacaaagccaaaagttggttctttgaaaagattaacaaaattgataaacccttagcttaactaagaataaatgtataaggaatgagggaaatagaaaatcaccattagaacacaacagtaataattattatgggcaaaatccactgatatgggtgttaaaattagtacctaaaagtttaagaaaaaataggttatttatatagtcccagagtatttcctctaagatactgattacttatgaatggaaaaaatagcaactttaaagtgaagaaacacagtagacaccactgtagtcaagcaatcaaaattaacatcaccagtaaaaagatatcaaaatcatttcttccctgatatgttgctctgagaagggcacagcaggaaccaaaccccaggtcttgtcacactccaaatcttcatagtgttaatcatcttgctataaatgagcatattttctttcaagaaacgataaatagatttgttgggagaaagcagcaaggcactacttcaatcagaatagtctatcatttgtgaaatatacgtagttctgtacagttactcagaaaagtgtaagtagtgagataagacagtgtctaataggatattccccagtctgatgaacagaaattaaataatgggatacaagtgaggctaatatataaaagaaaaaacagaatggaatagatatttactgatgcttgatacacagtaggtagtaataatacacagtaggtagtaataatagtaataataattatagcaaatatttataacaatagcatattttaatttcatttgatttgtaatttaatttgttaagtttatttaatactgatggcatgtactattatatttatctattcatttaaccctgaaaataaccatatgaggcaggtactactattagccccactctgtagataagaaaataaaggcataaaaagttggatcacttactaagcagcaaaacctacctgacattatactacctcccagaaaatatcagcttaattaataataagtgccagctaggatgctaaataccttacatatcccaatcctcaaaatattcctgtccagaggttttattataccaatttaaatgaaaaaaactaaggctctgattggttgcccaacacactgcaagatattgagcacattcggcttctacctggtaactgtcagaagtacccctcctcctcagttactgtgataagcaaatatgtgccccccataaacatttccaaatgcccctaagagaccagtacttccccaaagtactgctttaaaaagtactggttgttaaagactattaggtgagtagtgaacctaggtgtgtatgattccaaagccaatgttctttccaataggggcattgacttgtaaaggagttgaggtcaaaacaaatgtacaaagacagggaaacaaagtttcacaaagtgtaaggggcaatacactccagatgaggaaactatagtagcaaataactggaagttgaagtagtccataaagtataacagtaatttatgtcatttgttgaattaagtaagacttaaagcatggaccaatttgtaaagtgtatctcctgagggaattgggattttgttcagaactctgagtgagaactgacatcattaacatgttatttatttaaaaaggtctaagctgaataaaggtatgggggtgggaagtaagtcttcctaaaataatttattttaatttcaccattctagtattttcaaatctatttaggatgtttttccattcaatgttatataagctttagaatttatgagtaaaaatcatctacactagtcaatcttaataagaaattcagaacgataggagaaattattaaaaagcaatcctagtataattatgatatagatcacaaaacattctcccaaacatgcaaacataaacatttctatttccttaagagaatagctttagtatataatatacaaatattatgaatgtctgaaaactttaaaaattacaaatattaatacacaaaaattactgtagcagtagtctacaaccatattttggttgtttaatggaatttgcatacattagcatgtaaattcatgagcccacaaacacatgcacactgcaaacaaaaatttagtaatcaactttaataaatcagttacctttgcaataatgacttctttcttcagaatcttcatagcatagtattttccacttgccttctctcgaaccaaaataactttcccaaaagtgcctttacctagtagtttcaaatagtcaaaatcattcattgtctgaaaaatacaaattaaaaaatataatatgaagtatttgatgcaatttatttgttagcatatatatatgtgtttgcaatatccactcaaaaccaaattttaccaatttataagcacatttaaatgaaaaagaatcagactggcattggctgtctcattagcaaccatggatgctgaaaataatttaagcagttctcagatgttggagaaaatgattttgaacctagaattcctcagcgaaattatcagttgtgtaaaagggcaaaggaggaaaaaaattattttcactcatttttaaggactcaagttttcaaggatttagtagtgctgctacccccagaaaatgtgataatcaaaaatgttccacacaaacatttccaaatatgcctaaaaaagcagtgctttggaaggagctatctgagaatttactctagcaaaataaagataaaatccaagaaagagagagatataggatatatttataagaaatgtcgagaacctcgtatacttcagttaaaataaatcaaagaaagcagttgttattcctgagagagtactttatgcaattcagaacagcaaggaagggagctctaagaagaatatctttaattaatgtgcctgttttcagtttcacttctctttcttaagtcaggtaatcctgaggattttgccagtcacacgtgccacttgttctctacagtcccctctatgtactcttttcctgctctgctctatcaacattcttccagaaacttccaaacttttgaaggcatttgtgccctaatgcccctccccgacccagcttttcatttttgtggacttgcctccttttgaaattcctttactttcatattaataggtttttgaagagaagagaaggtaattgtatatgatcagtttacataaatttaaactcagtttagaggtttataaatatcaaataagtatttgggttttatcttgaaattacaagtcactgaaaattttagtgccttttataactttttttttctgtttatcatttatctaaagtaaacgtgagaaatatttcaaatcaattgtttcagtttccaccttaacaaacttaaaaaaaaagcaagttaacccaaaagagttagaagaaaatgatacagatcagagcagaaatcaattaaatttttaaaagaaagaaaaagagtagagaaaaaatcagtgaaaccaaaagctagttctaaaagatcaataaaaattgataagcctctggccaggttggtcagaaaaatagagaagacacaaattaccaatatcaggaatgacagaggtggcatcactacagattctacagatattaaaagaaacgtaagagactattataaatggcattttgacaataaaattgacacctttgatgaaatgaacaaattgcttgaaagtctcaagctttgaaagctctttctttgaaagaaacagataacttgataaccccatatttattaagaaaaattgagtctgtggttaaatacctttcatcaaagaaaactccaggcccagatggtttcactggtgaattctacagacatttaaacaagaaatgacaccaattttatacaaattctttctgaaaattaaaatgaggaatacttctcattcattctgagacaagcatcatcctgatactgagataggagtttggcaggtctcctttcacaagatgcaggtcacaaagaccctgctggtaaaacaggatacagtaaagaagccagtcaaaacccaccaaaaccaagatggtgatgaaagtgacctccggttgtccccactgctcattatacattcattataatatattatcatgccaaaggaacctcccatcagtgccatgacagtttacaaatgccatgacatatcgggaagttaccctgtatggtctgaaaacgggggaaactgtcagttctgggaattccctgccccttcaccagaaaactcaggagtaatccaccccttgtttagcatatgattaaaaaataaccacaaaaatagccaaccagtagccatcagggctgctctgcctatggagtagccaccctttcattcttttactttcttaataaacttgctttcactttattctgttgtttgctcttgaattccttcttgtgtgaagccaagaacccatgtggtctcccaggctgaaccccaattttttgacaataccaaaatgagaggaaaacaatgcaagaaaactacatcccaatatctctcatgtatattacataaaaattcttaaaattttagaaatgcctacgttcactttcaacattttttgctgctcatattttttataattttccccaaatgtcaaattaaagtgtcttacattcaataatatctctagttcaaagataaagtagcaaagagatagcagggaaaataataagatatattaattcaactaaaaatcaaacatgtagctctaaatatcaaatatagtaaatcagctagtgtcatttgaacaaataacaggtaatattagatttaattgcattaatagagcagaaaaaatcagggaatactacataacaagctatttgtgctaggtagtctgcaaagatggctgccacaaattcccatttctccctgtatgcacattccactcttcccatgaaggggtggagtcaactttctctctccccgggctaaccctgtatcttgctttgaacacagaatatgatcaaactgatactatgccagtaacagacaaagcctttaagcctggcagtttatgcgttctctctcttggaaagctctagaaagccagctctaatgctgtcagttagtccatattatcctgctggagagagaggccatgtggagagaccctggaagataaattaccactccgagagagagaccaagtggaggagaaccaagacaccatagccaacagtcagcaccaaggccccagacacataaggaaggttttgttggattttccagcccacccatgtataagctgtaggcagctgattgagagccatgcatgcaagaccaacagagtggcccaaactacaaaatcatgagatatttacatggctattgttttaagacattaaatttgaggtagtttgttccacagcgtgagggttaatactgagtgtcaatttgattgtattgaaagatgcaaaatattgatcctgggtgtatctgtgagggtgttgccaaaggagattaatatttgagtcagtgggctgggaaaggcatacccacccttaagccgggtgggcaccatctaatcagctgccagtgtggctagaatataaagcaggcagaaaaacatgaaaaggctagactggcttagcctcccagcctacgtctttctgctgtgctggaggcttcctgccctcgaacatcaactccaagttcttcagcactgggactcaaactggcttccttgctcctcagtttgcagatggcctattgtggaaccttgtgatcgtgtgtttaatactccttaataaactccatatatatgtgtgtgtgtatatatatatatatacacacacacacacacgcacacacacacacatacatatatacacacatatatatatatatattattaattctgtccctctagagaaccctaatacacatggcaagtaactcagaaacattattttcataaccaggccagagtgtcaatttattgctcaaagtttcatttggacagtatgttcctcatttttttatttaaaagcactagaaaataatacttgctgtgccttattattaaatatcatagaaaatgaaattgaattattggggggtaaaaattagaaaacaatctgtaaaatgctttatgacattttcagttgaaaacaatatttaattataaaatattactatattccttaagaattgcaatccttattcttggctgggcgtggtggctcacacctgtaatcccacaatttgaaagaccaaggcaggtggatcacttgagtgcatgagtttgagaccagcctgggcaacatggcaaaaccctgtctctacaaaaaaatacaaaaattagccaagtgcagtggcaggtgtctgtagtcccagctacctgggaggctgagttgggagaattacctgagcctgtgaagttaaggctgcagtgagtcacgattgtgccactgcactccagcctaagtgataggagtgagaccttgtctcaaatgaaaataaataaataagtaaatagtaaaattgcaattcttaggaacaatgaggctaaaaaaaaagtatgacagccttcactgaacttcacagcttgtcagtttgactctcaatctttaaaaaaaagggaatttacatggaaattactattagttaaaaagcactgtatgtgataaaatcagaaacagatttcccatctattttgacagaacttcaggaaattaaaaaggtatttttgctatcaaatgctcatggtcagaatggtatacacagtaattgtgtagtctttacaaatgaaatgtacactattacaaaatgttttggtcttctggatgatgttatggaaaaagatacagtaagtccttttttttgtttgtttgtttgttttgagacggagtctcgctctgtcgcccaggctagagtgcagtggcacgatctcggctcactgcaagctctgcctcctgagatcacgacattctcctgcctcagcctcccgagtagctgggactacaggcgcccgccaccacgcctggttaattttttgtatttttagtagagacggggtttcaccgtgttagccaggatggtctcgatctcctgaccttgtgatccgcccaccttggcctcccaaagtgctgggattacaggcgtgagccaccacgcccagccacagtaagtctttaataaaaatataggagtatgaatactctccagaaaaataatcctcctccaaagcctgatcttaagaatttattggggaaatactttacagttacactcttccctttacatgtttacgtggctgttttaggtaaagagatacatgggcatatataacaaatgcttaataaatgtgttcaaatcaggcacaccagaatataagacactgtctagcccacaaattagattaaaaataaacatataatcaatgaggaacataaagaacttccaagaataccacagtattagcatatttggtcaaaaaaagataaattccagatacatttacaatgtaacagcaaaaccaagtaagtagaaagaggaaaagagctctgacgaagttcactcctttgcctccatctctgcccacttctcctggtgctctttctcacgggaagaggtggagctaatgttattagtcaacttctacattggttacgtcgcttctcccttttaaataagcagattcatgcagtgtgagatcatgagatttcagcaggtctggccattgttctttttttccttctctttttctctggatactggccactggtatgagttactacagccaggaattaggtgatacaatcccaagaactggagtcaaacttagtgggaaagcaggaggcactgcttatactttaaacgtaaatcatgagattatagccagttgatcccagagaagcttatgctagtctgttaaaaattaagcagaattttgactctcacttggctttttatccttttatgctatgccccttcacatacttgacaaggcatacaagaatggtagcttggctgaccaagattaggcacttctgggttctctaagcaaattcctctgaaacgctatcttttaattaaaacatagaaccacattttcttttaattcaaacaaagaagagcacttaaatctgtctgtgaggcccttgcctctttacacccaacatccttcctttccaattgagtttttaactggcagagcagacactgtggcgataatccaccactaagggaggtaacgaaccctatttcatgcaagaaatagcagtctgacaactgtcaccatagccatcataatcagtacctattcttttaatcctattgccatttggcaaaaattaaagaaggaaatgtatcctataaattattagaataatattcttatttcacaatgtgtggttatagtcttaaaaataatccaaacttctgcaattctttgcatgataattgatatacataagggtatagttctagaatcatttatcttatgaaaatgacagtaatattttaccacttgaggctaagtcattaggaccgttatggagttagtagtggtacaaatgttctttttctgcactaacttctgcagtaatttagaactattttaaattatttcaaaaaagttaacagaacttcaaacatataagatcttttaattgtatactgtaacacgtcaatatacagcttatttctttttcttggttcatatatcttgagcctctctaatctctataatttttatgcttataatgaagttatattagaaacaaaattatgcagatattctcttatgactatactctgtttctcaaaatattatgaaaaactgttgtccttatatgacatttggatattagttaatttcaattgataataaagcttgtaaattcttgaaaaaaccagtagaactttactatcacaacctagtgctagaaagggaggagttcagatcttactgcctggggttaagtactggctcccaccctgtgtgtaattaaggggaaaatttcttaatccttccatcctttatttcccttaactataaaacaggaataataatggtacttaacttatagttgaagttcaaaatgaaaaaaaaaatgtttaaagtgtttatgtaatacgtgctcaataaatattagctattaaagttagctactattctttgtccacataaagataattaaacataaacatcactctaaaacatcttctcttagaattttttactccaactgagtctccaaaaagaaaaatccatagaggtattttgaatttggggttcaaatacttaaccatatcagatttacactattcttcatttcattttaaatgaaataatttacacatgtacaaaagaagctttcttatctctgagtaggtaggtgggtgtagctagactttgtttttctttttgcaatgatggaggaacaaggcagattaaattgacgtaaaagaaaagagggattcagttcaacaaacaaacagagtagaaatctacaatgaagacagaaagggatctcagacatttggcccagatcaagtatagaatattattcttattcacataaggaaaggataattaactttatgttgtgagtgtgtaacttcaccaagtccacaagtttaacgtggaaaagggaggatatgaactcaggcagtctatctccaaagagttcttaatcactgtgctaataccaaatttcatggataataccttgaaaatttgtgttttcctccctgaagattaatttacaacctattaaatcaaacatattctaaagtgataaatggcaagcttatctcaacacctctatctttaatcatgaaaatatcatttttgtaataaggaaattgcttttcaattttctattgcaatgaaaaaatttatattgctcataaaaatataaattcgtacttattatgctggaacactgagagaaggaaaagtctatttccctactgactcagaagcagccattaaataagagttattgtttccaagattgttcactttcctgctgactttactatgactgagggcaccaatcaggaagtacatccgagccattactgctcgtgcttttcgggagaatacgaaatgcgaaatggaaaagaacaaatcatcagggaaaacattttattacaaagtttctaaaattgtattaaaaataataaggaaaaaatgcaaattataaagtagtgtgatggcacatcagtcacacatgagccctatcagcattcagtgctaaagtgctggatcactgaaacaatgttcacctatttggttttaaacaacaacaggtatttcagattcatgtgaataagacccaccaatatatttacatatcgtaagaaaactggctgacatctttctgcaaatggtagcttttaatatgtttcttccagacaaatgaatgctgtgctgggaataagttattattttctacctttcttttatgatgggttgtagaggcatccatctcttcctctcctatattatcaatttgtgaagttggactacaattcattctctcctcttcttgcctctgcagtctgtctgctacagcctggatagcttctgtccattcttccctataaaaatgagtaaaatttcccattaatagaagatggtaaatgatttaaatattttccttttataaactatgaaatcaatacaaataaaatctattcagagatcaaacacactcaacacagataagcatacactctcaccatcaccccaaagtgaaaataatcctaagagcatttcattcaccacatgcctaaagtctgtagtagcattttttggaagtatgttaaagaaaaaaagagaagaaaaaaattgttgaaaactcgagttaaaatcatttacatgaaaagttaaattttatttgtctgtacatatatatatcctacttttttttttttggaaacggtctcactctgttgcccaagctggagttcaatagcatgatctcagctcactgcaacctccacctcgtgggttcaagtgattctcctgtctcagcctcctgagtagccgggattacaggcgtgtgacacaatgcctgactaatttttgtatttttagtagagacggggtttcaccatgttggccaggctggtctcgaactcctgacctcaagtgatccatccgccatggcctcccaaagtgctgggattacagccatgaaccaccgcacttggccaatcctaactattaagttgaccccctaaaagtttgctgcagtttttagaagtgttttgcttagctattttaagtccatcattgacatcctgaagatttctatgaggtccaacagacattccaaggaaaggttttcaaagccaaaacctttcattgtttccagatcatagtaaatttcttagaaaaaattaaaaaaaaggatacagcttgtagtttgaacaatcagtctcaggagcatttatatcaagcatttattttttgacatttggttatcagaccaaggatcattatttttccatgtgaattttaaaatcagcttgtctacttcttaaagtctatttggattttgactggaattacattaaatctatagatgaattttgggaaaactaccatcgtaatcatttaaatcttccaatccatgaacatggtatagctctacatttatacaggtctttaatttcccaatgcaatgtttgtaattttctgtgtaaagatctttcacatctttaactgaatttattcctacatacaatcatgcaccacataacaatgtttcagtcaatgatggactgcatatacgatggcagtcccctaagattattacactgtatttttactgtacccttcctatgcttatatgtttagatacataaatacttaccattgcattacaattgtctatagtattcagtacactaacatgctgtacaggtttgtaaactgtgagcaacaggctacaccaaatagcctaggtatggggtgggctataccatctaggtttgtccaagtagtatgtttacacaatgttcctaatgacatgtttctcaaaacgtatcactgtcattaagtgacacaagactgttcttttatgctattgtggagggttttatttcactttctaattgtacttattagtatttaaaaatacaattgatttttgtatattgactttgtatactgcaactttattaaattcatttattagttccagtcactcttatttttctgcattttctacacatgcaaccatgtggtatgcaaacaagagcagctttacttgtttccaatccgtatgctttttacatctttttcttgctttattgccctagatcagacctgcagtacaaagttaaatgaaagtaaacagcagcatacatgctttgtttcacaagttaggaataacattgttttcatcccccttgaatattatgtaagttgtagatcttctatataacatttacttaatcaactaagttctattctatttctagccatctgcatatttttaatgaaagtttgttgaatttttgtcaaatgtaggccaggtgcagtggctcatgcctgtgatcccagcactttgggagactgaggtgggcggattacctgaggtcaggagttcaagaccagcctggccaacatggtgaaacctcgtctctacaaaaaatacaaaaattagctggatgtgctggcaggagcctgtaatcccagctactcgggagactgagacatgagaatcacttgaacccaggaaatggaggttgcagtgagctgaaatcacaccatggcactccagtgagggtgacagagcaagactccgtctaaaaaaaaaaaaaagaaaagaaaagaaaaagaaaataaaactgtcaaattctttttctgtatctctataaaatgatcacacagatttttaactttatcatattaatatggtgaaattagcttaatagtttccagatgttaacacaactttgaattcttgggagaagctccatttggccacataacttaagcttttatgctttttacctattgtttaatttgttgatactttgttaagaaattctgcatatgttcacaagtgtattgggctatagttgtcttttcttaaaatagttctgtctgatttctgaaatgagggtgacagtggccttataaaataagttgagaagtactcccttctcattattttctcaaacagcttgtagaggattggtcaaatttctaacttaaatgtttgacagaacgcaccaataaggctgtctgggcttggaacctttgaggaaaggttcttaattactaattcacttccattcattgatattgggttttctaatgttttcttggatgtcagtaatttgtgtcttccctctttttcctttaacaataccccaaaacgtttttcaattctattaatttttttcaaagagtacttttggttttattaattattctctactatttttctgttttctatttcactaatttctgattgctgttgtttctgttttcttttggtttatttttctggtttcttaagatacaagcttaagttaacgatgtgagaaatttcttcttttcaaatacaggtatttaaggctacaaatttccttctaagcattcatttagctacaccccacaaattttgatatgtattattttcattattgttcatttaaaattattttctaatggctcttgtgagttttttgacccaatgattataaaaaattatgttaatttccagtaattgacatctattgtcttactgttattgatttctaattaattctgtggattacagaacatacaccatataactttcatcttccaaaatgtactcagaattattttatgaccaagaatatgttatgtgtatatgtgtgtgtgtgtgtgtgtgtgtgtgtgtgtgtgtgtgtgtgtgtatgttgggtgtgtgtgtgtgtatatatatatgttatgtgtatatatatatacacatacacacatacatacacactttaagttctggggtacatgtgcagaatgtgcagttttcttacatgggtatacatgtgtcatggcggtttgctgtgcccatcaatccgtcacctatattaggttatttctgctaatgctatccctcccctagcccccaactccctgacaggccccagtatgtgatgttcccctccctgtgtccatgtgttctcattgttcaactcccacttatgaatgagaacatgggatgtttggttttctattcttgtgatagttggttgagaatgatggtttccagcttcatccatgtgcctgcaaaggacatgaactcatccttttttatggctgcatagtattccatggtgtatatgtaccacactttttttatcccgtctatcactgatggacatttgggttggttccaagtctttgctattgtgaatagtgccgcaataaacatacgtgtgcatgtgtctttatggtagaatgatttataatcctttgggtatatacccactaatgggattgctaggtcaaatggtatttctagttctagatccttgaggaatggccacactgtcttccacaatggttgaactaatttacactcccaccaatagtgtaatagcattcctatttctccatatcctctccagcatctgttgtttcctgactttttaatgattgccattctaactggtgtgagatggtatctcattgtgttttgatttgcatttctctaatgaccagtgatgatgagcattttttcatacatttgttggctgcataaatgtcttttgagaagtgtctgttcatatcctttgcccactttttgatggggttgttttcttcttataaatttgtttaagttctttgtagattctggatattagccctttgtcagacgaatagattgcaaaaattttctcccattctgtaggctgcctgttctctctgatgatagtttcttttgctgtgcagaagctctttagtttaattaaatcccatttgtcaattttcgcttttgttgccattgcttttggtgttttagacatgaagtctttgcccatgcctatgtcctgaatggtactgcctaggttttcttctagggtttttatggttttaggtcttacatttaagtctttaatccatcttgggttgatttttgtataaggtgtcagtaaggggtcagtttcagttttctgcatatggctagccagttttcccaacaccatttattaaataggggatcctttccccattgctttttgtcaggtttatcaaagatcagatggttgtagatgtgtggtattatttctgaggcctctgttctgttccattggtctgtatctctgttttggtactagtagcatgctgtttttgttactgtagccttgtagtatagtttgaagtcaggcagcatgatgcctccagctttgttctttttgctcaggattgtcttggctatgcgggctattttttggttccatatgaagtttaaagtagttttttccagttctgtgaaaaaagtcaatggtagcttgatggggatagcactgaacctataaattactttgggcagtatgaccattttcttgatattgattcttcctatccatgagcacgggttgtttttccatttgtttgtgtcctcttatttccttgagcagtggtttgtagttctccttgaagaggtccttcacataccttgtaatttggattcctaggtactttaagctctttgcagcaattgtgaatgggagttcactcatggtttggctgtttattattggtgtataggaatgcttgtgatttttgcaccttgattttgtatcctgagactttgccgaagttgcatatcagcttaaggagatttggggctgagacaacggggttttctaaacatacgatcatgtcatctgcaaacagagacaatttgacttcctctcttcctatttgaatatcctttatttctttctcttacctgatttccctggccagaactttcaatactatgttgaataggagtggtgagagggggcatccttgtattgtgccagttttcaaagggaatgcttccagtttttgcccattcagtatgatatttgctgtaagtttgtcttaaatagctgttattattttgagatacattccatcgatacttagtttattgagagtttttagcatgaaggggagttgagttttgttgaaagccttttctgcatctattgagataatcatgtggtttttgtcattggttctgtttatgtgatggattacgtttattgatttgtgtatgttgcaccagccttgcatcccagggatgaagctgacttgatcgtggtggataagctttctgatgtgctgctggattcagtttgccagtattttactgaggatttttgcatagatgttcatcagggatactggcctgacattttccttttttgttgcgtctctgccaggtttcaccaaagtcaaaatgtaggaaaaaatgttgagggcagccagagagaaaggtagggtttcccacaaagggaagctcatcagactaacagcggatctctctgcagaaaccctacaagccagaagagagtgggggccaatactcaacatccttagagaaaagaattctttttttttttttttttctgagacggagtctcactctgtcacccaggctgcagtgcagtagtgcaatcttggctcactgcaacctctgcctcctgggttcaagagattgtctgcctcagaatcccaagtagctaggagtacaggtgtctgcccccatgcttggctaatttttttgtatttctggtagagttggggttttgccatgttggccaggctgatctcgaactcctgacctcaggtgatccacccgccttggcctcccatagtgctggaattacaggcaagaaaagaattttcaacccagaatttcatatccagccaaactaagcttcgtaagtgaaggagaaatagaatgctttacagacaagcaaatgctgagaggttttgtcaccactacagggcactaaacacgcaaaggaacaactgataccagccactgcaaaaacatgctaaattgaaaagaccatcaacactatgaagaaactgcatcaactaatggtcaaactaaccagctagcatcataaagcatcaaattcacatgtgacaatactaaccttaaatgtaaatgggctaaatgccccaatgacaagacacagactggcaaattggataaagagtcaagatccatcaatgtgctgtattcaggagatccatctctcatgcaaagacacacacaggctcaaaataaagggaagaaggaatatttaccaagcaaatagaaagcaaaaaaaaaaaaaaaaaaaaaagcaggagttgcaatcctaatctctgataaaacagactttaaaccaacaaagatcataagagacaaagaaaggcattacataatggtaaagggatcgatgcaacaaaaagagctaactatcctaaatatagacgcatccaacacaggagcacccagattcataaagcaagttcttagagacctacaaagagacttagactcccacacaataatagtgggagaaagagacatgaaaaaacccttcaaaaaaaaaatcaatgaatccaggagctggttttttgaaaagatcaacaaaatagatagacctctagccagactaataaagaagagagaaaaatcaaatagacacaataaaaaatgataaaggggatatcaccgtcaatcccacagaaatacaaactaccatcagagaatactataaacatctctatgcaaataaactagaaaatctagaagaaatggataaattcctggacacatacaacctcccaagactaaaccaaggagaagttgaatccctgaatagaccaacaacaagttctgaaattcaggcagcaattaacagcctaccaaccacaaaaagtccaggaccagatggattcacagctgaattctaccagaggtacaaagaggagctggtcccattccttctgaaactattccaaacaatagaaaaagagggaatcctccctaactcattttatgaggactgcattatcctgataagaatatgttccatcctgatcaatgtaccatgcttacttgaaaataacgtctcttctgccacttttgagtgtagtgttctataaatactaggtatatcaaggtggttgacaatgttattctatgccttagctagttttttgtgtagctcctctaccaagtgctgagaatttttaaatctccaaatatggttgtgaaattgcccatttttatccctttaattctgttacatgtgttgatgactgctatatcatcctgttcaacagaaacttttctcattataaagtatcctagtaatctatggtaatacatttaatttgaaatgatataatacggcaatccattcttcttatgcttactgtttccatgatcaatctttttcaatctatttattttcaacctgtatctttatctttttctcctttcctgcctgttttttaaattattttgcactttttcagaattccattttaattttcctgttggcttttcagtcgtctttttttgcaattatttttatatatatccttagctttacatggtccacttatgtaatatatgccagaataatttctaattccatttctcctccaattagcctggtagccatcatactctcactgtctttttagtaattgtaacttaaattataatatttaactttgactttgcaaagtctaaaatgtccatacttttaactcttaccagaaaatacagcaacctcacaaaaaattaactccatttttgtcaggatctcaatttatattacttcagatatttttcacttatataattaaaacacaacataaattatttaaaaatcaatgcttacttttatttattggtttatttaagcattttgtttttcattccattctgtacttatcctcctgagattattcttattgtgtccaaagaatactaggttagttattataggtgtgctagtgacaaatcttatcaaattattggagggtgaagggagtagagacaggatctcactatgttgcccaggctggtcttgagctcctgggctcaagtgatcctcctgcctcagccttccaaggtgctgggattataggcataagacacaatgcccagcctctttcaattttttactgaaaatattttcattttacttttattcatggaaaatagttgtttcttagcactcattttctttcagaactttggggatatcatttcatcatctttggaaatattccattatttgggaacattattcaattatatttcattattattccatcccacatattgacattatcttttggtctacatgctgctgctctgaaagcaaacatttttttctctgtctacattggggattttcccactatctttgttttttaatagtctaatgagattagggattttcttcatatttttcctacttgagatttataggacttttgaaactatggtttggtatctttaactattttttaaaaaatttcaatcattatattttcaaatactttttgctctattctctcctctccttctaaggctccagttatatatatgtaagacatgctcaccgcattgtttttatcttacattctattcttaattatttttattttctatcctcttatctttgcatgtttcactataaacgttctgttctgacgtatttttgagttcgctaattttctctaatgtgaggtctagtttgctattaaagccatctgctagaactcataattccaaatgttttgttttcaattttagaatttctatggggctctttctttttaattttaccttgattacaaatgaaagctattatccatttgtttcttttttatactttccctctgtagaatcaaacaattttaacatacttgaacatactaattaatgtatagttcttttatctagagttcctatgaatatgattctattgtctgtttttttttcctctattattttggccacatagtgttgaatttttgtgtactcattttttaacaagtcctggacacaacacatgaaaactgaggtaatgtgaggtctaggaagatataatcttctgttagagtgagtttacatttgcttttagcaagctcctagaaaactagcaaagttgaatcaccttcactcaatttcaggactgaaataatttatagttatatgtcaatcctctcaaagcaaatctatttccagtttactctttcttacagggtacagtcctttaagctaccaataccaaaatgtagtggtttaccatgtctcctctttggcagatcctagattccaaaatatcactcccagctctgggagctactcaaaatctctccatctccaataccacttcaagaactagcaggtaacccaaaaggaaaagtaggttcactgtctgggtttctttcttcaatacagttttggcccaataaatcttagccttatcagctctctggtgtctttttaaaaaacaaaaacaaacaaaagtcttttccagcttcactagtggtagttagctggactactgacccaaattacataattcaccataattcatgatacttaaactataaccctacaccatttggtgagggtgtggcgggggggtgtgggggggtaattcctgcaaaaaagtatcaggccaaagtacctgactaattgaaagagggcatccaatctttttattcctaaataatgtttaaaaatgtaattaatttgaaaaacagaatggagacccctatgaaacaagtacattaatcttttaaaagtacatatactacttcatacaaaaatcaattttcaccaactgattagttacttactaataaatatttaattaaatgtctaatacatgtgtgctactaaagtttaaaaaaggaatggcttaggaagaacttacagtctgatgggggagccttggtattgtggggaagtataataaaatgttatgggtaaaatgatacaagtatacgctaagtacagtggtgttctaacaataataaaagtttgtgatggggacccaaaaagaaaggtaattcttgaatgtagatgtgaaaaatgaattggtacttaccaggatgagcaagagacaagcaaaggatacgaggtgttcctagcagtagggacaaaagggcaagaaggaaagagctacaggtaatgtaagagcacagtatagcattagtacttgggaaacaacaaggagttcaatgtatctggaacatgttgggggcgaggcatacgtgtgcgcatgcacatgtgtctctgtatgtgagtgtgagtgtcgtggccatggttgtgacagtgaaagtagttagctgttaagaaagaaaaatgacctttgtctatattgtggatggtcatgtgcagcataataaagtacatatacaaatcatatttaacagtaaattagtggtgtatccaataaattaagaaaaaaggtatatgtgctatgatcaaaattattaaacattgctttaaaacacacagaaataatacataaaactatcagaaatgaagagataaaattgttattgtctgcagatactaggtctacaaagaataaatgttttgggttacttaaccccaaaggtgatggtattaggaagtgggccttcatgaggtcatgatagaactcatagattaaattagtgcatttatagaaaagtcctcagagagttcctttggcacttttactaggtgacaatacaggggaaagacaccttctatgaaccgtgaagagggccctctctagacactgaatttgccagcaccttgaacttaaacacctggcctccagaactgtaagaaataaatttctattgtttataagctactcagtttatgatagtttgttgtagcagcccaaagggactaaggcaaatcccatttacaaaagcataaaaaagaataaagtactttaggaataaacttaaccaagaaggtgaaagatttgtacactgaaaactacaaaacattgctgaaagaaatgaaaggagacacaaataaatggaaagacatcccatgttcatgcactgaaaggtttaatattgttaagatgtcaacaccacaaagtaagctacagattcaatgcaatccttttcaaaatcctacagcatttttgcggaaacagaaaaaaaaaatcctaaaattcgtatggaaaccataaagaatcccaaacagctgaaacaatcttgagaaagcaaaaagctgagggcttcatacctcctgacttcaaaatgcattctaaagcttcagtaattaaaacagattggtactggcataaagacatatagactaatggaacagaacagagagcccaggtaataaaaccatatatatatacagtcaaatgatctttgacaagggcgtcacaactaacacaatgtggaaatataatgctgctgagaaaactgggtatcaacatgcaaaagaacaaaagtggagccttattttacaccacacacaaaaccaactcaaaatggatcaaagaataaatataagacatgaaactacaaactcctaggaaaaaaccacaggagaaaagcttcataatttggtctttagaaatgatttcttgatgctgacaaaagcagtaatagatgagtagaagtatatcaaaataaaaagcttctgcacagcaaacaacagaacaaaacagaaaactacagaatgagagaatatatttccaaaccatatgtctgataagggcttaatattcaaaatgtatagggaactcctataactcagtagcgaaaacaaaaaacagaaacacaagtaaaaacttggcaaaagacttgaatagacatttcttcaaagtagacatacaaatgatacacaggtatttgaaaaatgcttagcattacaaattatcagggaagtacaaatcaaaaccacgatgaaatatcaccttacacctgctagtatggctgttgtttttaaaaaaacaacaacataaaaaataaataagtaagtgtcagcaaggatgtggagaaattaaaaccttgtacactattgttgggaatgtaaaataacgtagctgctacagaaaacagtatgaagattcttcaaaaacttaaaagtagaactaccaaatgaaccagcaatcacatttctggatatttattcaaacaaagtgaaatgaggaacttaaacaaatatctgccctctcatgctcattgttgcactattcgcaatagccaagaggtggaaacaatctaaatatccatcagcagatgaatgaataaagaaaatgtattggccggcagtgtggctcatgcctgtaattccagccgagggaggagtattgcttgaggccaggagttccagacaagccctggcaacacagagaaaccttgtctctacaaaaaaaaaaaaaaaaaaaaattaacttagttgcgtgtgtggctgtagtcccagctactggggaggctaagctgggaggatcccttgggcctgagttccaggctgcagtaagccatgatcacaccactgcactacagcctggctgacagagcaagaccttgtctcaaaaaaaaaagaaagaaggcaattgtgttatatacatacaatggaatattattcagccttaaaaaagaagaaaatcctctaatatgctgtaacatggattaactttgaagacattatactaagggaagtaagacagtaacaggacaaacactgtatgattccacttatgtgatgtgtctaaagtagtcgaattcacagaagcagaaagtagaacggtggtttccaggggctgggggtatgggaatggagagctactgttcaatgggaacagaggttcagtcatgccagatgaaaacgttctagagatctgctgtacaataatatgcacatagttaacaatactctattatacccttaaaaatgaaagaggatttcacattatgtaatttttaccataattttttaaaagaatgcactaatgtagctaagaacatttttgttaaaaaaaataagggatatgttgctatattaacagttaaaaattttatagtttctctaattaaggccatgtggtgttaatgctagagtacagaaaggtcaaaggggaaaaaaagactaaatcctaaaagcgcaaatatgtatatgtgttatccacaatcagtgagaaaaaaatggattatctaataaatggagatgagatgatgggctcgccattgagaaaaaaatagagtccacccttatatcatgtactgaaataaatataagacaggtgagagatatacagatttagtttatgacaggtaaaaattttagactgggcagaatattaaaaatagagagtttttctaactcacactaaccctctctaagtcttcaatgatattacactaaagtcatatagattcagtttgccactattttattgaggatttttgtatcaatgttcatcaaggatattggtctaaaattctcttttttggttgtgtctctgccaggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttcgttggtaagctattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtattctctgagggtagtttgtatttctgtgggatctgtggtgatatcgaatccagcagcacatcaaaaagcttatccaccatgatcaagtgggcttcatccctgggatgcaaggctggttcaatatacgcaaatcaataaacgtaatccagcatataaacagaaccaaagaaaaaaaccacatgattatctcaatagatgcagaaaaggcctttgacaaaattcaacaacccttcatgctaacaactctcaataaattaggtattgatgggatgtatctcaaaataataagagctatctataacaaacccacagccaatatcatactgaatgggcaaaaactggaagcattctctttgaaaactggcacaagacagggatgccctctctcaccactcctgttcaacatagtgttggaagttgtggccagggcaattaggcagaagaaggaaataaagggtattcaatcaggaaaagaggaagtcaaattgtccctgtttgcagatgacatgattgtatatctagaaaaccccactgtctcagcccaaaatctccttaagctgataagcaacttcagcaaagtctcaggatacaaaatcaatgtacagaaatcacaagcattcttatacaccaacaacagacagagagccaaatcatgagtgaactcccattcacaactgcttcaaagagaataaaatacctaggaatccaacttacaagggatgtgaaggacctcttcaaggagaactacaaaacactgctcaaagaaataaaagaggatacaaacaaatggaagaacattccatgctcatgggtaggaagaatcaatatcgtgaaaacggccatactgcccaaggtaatttacagattcaatgccatccccatcaagctaccaatgactttcttcacagaattggaaaaaactactttaaagtacatatggaaccaaaaaagagcctgcattgccaagtcaatcctaagccaaaagaacaaagctggaggcatcatgctacctgacttcaaactacactacaaggctacagtaaccaaaacagcatggtactggtaccaaaacagagatatagatcaatggaacagaacagggccctcagaaatgacgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcaagggcaaggacttcatgtctaaaacacaaaaagcaatggcaacaaaagccaaaattgacaaatgggatctaattaaactaaagagcttctgcacagcaaaagaaactaccatcagagtgaacaggcaacctacaaaatgggagaaaattttcacaacctactcatctgacaaagagctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggccattcctcagggacctagaactagaaataccatttgacccagccatcccataactgggtatatacccaaaggactataaatcatgctgctataaagacacatgcacatgtatgtttattgtggcactattcacaatagcaaagacttggaaccaacccaaatgtccaacaatgatagactggatgaagaaaatgtggcataaatacaccatggaatactatgcagccataaaaaatgatgagttcatgtcctttgtagggacatggatgaaattggaaatcatcattctcagtaaactatcgcaaggacaaaaaaccaaacaccacatattctcactcataggtgggaactgaacaatgagaacacatggacacaggaaggggaacatcacactctggggactgttgtggggtggggggaggggggagggatagcattgggagatatatctaatgctagatgacgagttagtgggtgcagcgcaccagcatggcacatgtatacatatgtaactaacctgcacattgtgcacatgtaccctgaaacttaaagtataataataataaataaaataaaataaaaatttagaaaaaaaaatcaagtcatatagaatgtccaaacaccagattctagaggtatatagaaatgcacataccaatggcaaatatgagtatgctgtttttcatttgtattaatactgttttttcttatagttataaatgcaaatgaaaactgattgttcagaagagtagtatattattacaggaacagcagaggattttagagtcttaagatctgacagaaatccagctttgtaaacacaaatggcaaaatgaattgtgcttcaacagatgttaaaaatccactaagaataacattttcaaagaatatatattgacatgggaaaagtaccattcatccagccagtcaataaatactgtgttgggccatggactatgtgcaaaagatgttttaaatgagcaaggaagccatcatctttgctgtcaagaatcttcaagtttagtgagaatggcaaacaaggattacagttataatatgattgatagaaaaggtacaaagaaaaatatctaagtacctagcaggggaacctgcctagtctattagagtcagaggttttgtaggaaaaataacattttaagctcagatctgaaaagatacataggaattagcccaacttagtgattatggattatgggtggacatatcaacaaattgaaagctcagtattaattatcaagggagaaaaggcccaggatcaatggtggggaggggagggtgtgcggggagggaggcagtgcagggaggggagggtgtgcaggcagggtaagagttcggggacccatacccagaactgtatctatatgaaaggcctaattacgtctgcacatagtaagattggaagtgcacaaaagaaaatattatcagtgcttaactcttttctatatttcttaatcaatcatacattaccatttactctactgatcaaaagtgttattaaaataatactttaccattttgcttttattaaaattttagacaagactgttaaaactttgtgtattcatttggaaaataaggctaataagatttaacttcacaaagttgctgattaggatcaaatataataacatgtgcaggatggtggttttgtgactgtggtcactggacctaactcagtatcagagtgagcagatatagaattgggaagtggttgtaaaaactgatagatcaggaggataaaaatgtggacctgatgaagttgatgagttggttactacagtgttgtcactacccactttagtaataatgacagtcaatgctaattaatcctctctcccgctccttagacccaatctcagaatccttagcaacttagtgctccagacagccacttacaactaatttagaatggcatgttacttgaaatcttttactatcactagccttggaatttcaagtatgaatacaatcaattatacaattttttaaaaaaggtagtttggctataaaaatgtctttttttttttttttttttttttttttttgagacagagtctcgctctgtcgcccaggctggagtgcagtggcgcaatctcggctcactgcaagctccacctcctgggttcatgccattctcctgcctcagcctcctgagtagctgggactacaggcgcccgccaccacgcctggctgattttttgtgtgtgtgtttttttagtagcgacagggtttcaccttgtcagccaggatagtctcgatctcctgaccttgtgatccacctgcctcagcctcccagagtgctgggattacaggcgtgagccaccgcgccaggccaaaaatgtctttttaaatttatattttaacctttaaatgttctgtttctctgaaagtatatcttctagcatgcccagaggttctgatatattaaatattattttgtaagccactgttattcatgtattatgccagaagcaagaatttagagactatagcatttaaaaaaatatatttatatatatttacaaataataaagtcagatacaaatacatctttagattgagtgttgctttttcacaaaatgaaaacaagtgaatttcttacctttcctctggagtatctacatgaaatgttctctctataacagtagtccactggagacatctgattataaatgtgtttggctttggtcgttctgttttcattaactggcattctaagaataaaataaaatgtttctttaaatatggatatatttaaaacaagaagtaaataattgagaactacagagttctattttaaacaaaacccagtgcgaactcacagctttctatggttctccactcaagattatttacagcctgaccttagtcttcctttccaatccttcacccattctggccacattaaccacctcaactggactatataattttccccaaacacacatcttaactctttcatttatttatgcctttgctccagctgttcttgctatctgaaatactttcctcacttattttacctctatccatatgcatcacctgcagtcacaatagtactgatccttgaaggtccagatcaaatattattccttccatgaaaccttccataacacctcgccctagactgaccatttcatcctctctattctctttacttattaccatatccctcatgtgtcacttaccatagactatcttacagtattacttatcattttaagaaaatgacaaatatcacttatccttacctagattataagctttttgacaatataaactgcctgtaactcttagtatccactgccccaagagccagtcactctaaacatgattaaattctgttactgaataactaggaagatgtcaacaaacatgagcctaaagtatggattctctgacactggtgtgcgtagattcaattattttttcgtaccattaactacacaaacttggacaaattaattaaactcgctagtcttcaacagttaagtgggaaacagtatctacatcatagaattgatgtaggaattaataataagttcatctaatattagcataatatgagacctataagctttcaacaaacattaactattatttggcatacatctgagctgggctttaaaggataaatggtattggacaccaagaaaaaatagggtagggttgtctgctgactctgctcttttggaagaaactaatttatctccgttgaaaacttcaagtcttttctcagtgcttatctgctgtgtcctatctccatcattagcaactatcaactgccatttctatctctttatagttccaattctttactcagattagctgtgtttttgtttgtttgtttgtttgagacagtctcgctctgtcacccaggctggagtgcagtggcgcgatctcggctcaccgtaacctctgcctgctgggttcaagtgattgtcatgcctcagccacccaagttgctgtgattacaggcgtgcaccaccatgcccagcttatttttctaattttagtagagatggggtttcaccatgttggccaagctgatctcgaactcctgacctcaagtgatccgcccgcctcggcctcccaaagtgctgggattacgggcttgatccaccgtatccagccccagattagctctttattggccctttacactgagagaaatcattcacccaagggtctctgcttagttttctaacagtttacatgttttcagcaatcatctctcagtttaccaatatcaaaatccaaacttttttcaccttgcagttctactttaagacacacgtgtctaaacacatagtgaatatttctacctggttgaattactggaccacccctaaaaccaaactcagtattttccccctaaaattcattcctcctcctggctttcataattttccatcacccaggctgaaacataaactgatcttcctttttgatactggtactatttgtcattacaggtgctcctcgacttatgactgtgttacattccaatacaaccatcgtaagtcagaaatattataaggcaaaaatgcatttaatacacctagactacccaacatcatagattagcctaacctacttgaaacatgctcagaacacttccattagcctagagttggacaaaaatcatccaacacaaagcctgttttgtagtaaagtattgaatattacacatagatgggtgttttgtcgacatgatgagatgagaaaacacaaaaactaagagcatccagaaaaatgctggcaacacagtacactgtagagtatctactgtgcatgttgtgatcacgtggctgactgcaagctgtgatttgctgctgctgcccagcatcactagggagtatcacacagcaaatcactaccccaggaaaagacaaaaatccaaaatttgaaatacaatctccattgagtgtgtactgctgtcaggagcacggtaaagtaagacatcgttaccatgaactactgtaagtgggagaccattcgtaactggttttccactgctataattctacttcagattctgtgtgcccaatgcctaaacctcccggctgccctaagacaagattcttcctatttagagatgctgagtgactatgtaagttaaagacagaaactgtgctctgggagacatctgaacatgtccgaacgtgaactcttgacctctctcaaccctgctccttcttctgccaacctctactgtggcttcctctatctcacatgacacctccatcctttcaattgcccaagctgaaaacccaagaattcccttggagtcctctcttccctgacatcacattcactcctcctgcaaatcttggtgtttctactttaaaaacataaccagcttctgataacttctcaccacctccactacctcagactaagccatcattgtctctcacctgatgattccaaaaaacttagaatagcttttccctgcccctcactgcagtctgttctcaacacagcagccagaaatcttcttaaaatgaagatctgcaaaaaagttctgcagtgtttcagttcactaagaatagatgagtaaggcctttaagtgatcagcaggtgtcctacgtgatctgaccctcccactgaccccactgaagtttctgacctacttccttagtactctctttcaggctgctctgccagccaccctggcttccctgcatttcctcaacaatgcactacactctttctgctttagagctttttgccctctgcctaacattctttcccccctcacacacccgcacagctgctctcttagacatcctatttaatactgcaatctgcaccccttacctaggactctccctccatcttctcttacctgctctattttttattttccatagcatgttaccattttctaacatttgatatgaagttttttagtatcttttttgcttattgtcttttcaactagattgtaagctccattcatatattcttagcacttagaactatgccagacacatagtaggtactcaataaacattttccaaatgaattctgatagtaataatccaacaaagaaggtaattttgatgctaccaaaagataatttctaaagcaatgtacctatataagcaagaagggattaaatttactggacaagtaaaggggtagctctaatcaggagtataaatagtttagtaataaaataaaagagaagatataagggcccaaatgcaattaggagtacagaagcaagtaaaagctggtagaaattattttctcactgcttctgtttttttcagtgaattaggatataaagtcatcgggaataacgttgcaaaaggatccatcaggctttgaagaaaaaaagatatgaaatagcactctgggaaaatcaaagtacaaataggctaaggagaccaaccatgactgccgagaaggatgaaggaccaacctgaatttaataatgaagaatttaaactaataacagagatcatggttgtgtattttctcccagatatacccagatatattcagctgcatgtgtacaggtgaggaacatagagtaatgaatttaagcaaggctgtactttaaccaagtaagtttgtcaaagcaagaagacagaaaagaataaagaatgcaaggcaagggagtgattatgatactcaactaagaaacttaaaatgggtatggaggaaagtgagaacctggggatgtgcaagacaatgaaaaggtggtagaatcaataggtcataaaatctattatatcacaattcaactttgtatagcagcatgacattttttgaaatatgaaagttaaaaaacacaaaatatatattccacaaaaaataagcaaaaatattgttcatttgaaagacttaagttttaaaataccaaagacattatactaatttatactaataaagagccaaccaattcctatgactgactctgcccatcagtctgattctctttgaagccaactgttcctccccatatccttcttttcaaaagccctattaaatttccagccagtaattcactagctatattacttaaaagttaggaattgtgtgcacagttcttcttatagcacctaggacagtgacaggacataggagtatacaataaataccctgattgggcaactgattggctggctttaaacgtaaagaatggaggacagacacttaaatgaggggcgtgcccaagagaaatactatggggtacagagaaatacagcacagaagcaaagaaagaatgcccggtctgaggttcactatttcagttttacttcaggttcccattatggtgatataaggtaattaagataatggactctgcaatcagaaagaaattcaaatccaggctctaacacaatcagctgtgtgatccttttgaaagtactttatatctaagccctcaggtttatcatctttaaaagcactatcatgaattaaaagcatattttcaacactatacctaaatgaagtttaaatgctataatttaaagaacttctcaacactagacttttagaagctactcgaagtgctgttataagattccaaatatcaattactataatttataaggctgctaaaaacaataaaagatattactataattaccattctcaagcagatcactgaaaaggaatggcttagaaaagaataaaatacctgtatttatgtatagagtggtttggaaaaatattaaaatagtaacataatgactaagtagttatgcacaacttcactgttcttactaaacttgctaagtattcatgaaccaaatgacatatatgaaatgtcagttatgggccaagcactatgcaaaatgctgggcacacaaaaatgagtaggaaactctatgagctcatggtacacaccatactactgatcattctacccatgtaattataaagtagtatttcatttatgctataaagggtttaatcaggtcctgtgaaccctctagtccaacaaaaataatgttacgtgtaattacaaataaacagtataatagaaataaacctatattttttaggtctcagtatgaaatactctacaaacacatttcatctctacaccaagatgttcaagtggtagttggatcactaccaagagaatatcacaatgtcttatggtttgttgctgtacaaaacaaatgtaatttaaaaagctgaatccaaattcaaaaaagttaaaactctaaattaccatgttaaaaccagtgatcgagtaaatagaaaaacttttgagttcttgcatgttcgcaataaggaatcagaaacacatgattcttaaaggaaatggtggttaataaatggattagccaatacttctttagaagaatatttgccttttggttacgtaaagattcccaacgcaaggtagggcaatttaaattttaaaaatcagaagtagaaactttggatagagattctaaaaagctattaaccaaatgattatctacgatttttagaatcatttaatatgcatcagtaaagtaaatgtgcttatacaaaatgccaggtagctaactcttattataacatctacttctcagtgttatttgttacactgttacttatattagatagttatacactagttaaactctactgagcaacatgaaccacaagctgaattttaaatgttctgcttactttacaccattctgagccacagatgacaaagtctgtacaaagctgtaattactctgcaaacctgaaacccaattagagagactgcaacatgtcagaccaagaaatacatacaccaaaaaaaaaatttttagagatcatctgtttagattaaaatgtttaaaggtttaatttcaaccaacctctttagccatttaaacactaattttattctttctaaaataacatccaatgtgaaaaacgaaggcataataatagattccttttttttttttttttttgagacggagtctcgctctgttgcccaggctggagtgcagtggcgcaatctcggctcatgcaagctccacctcccgggttcatgccattctcctgcctcagcctcctgagtagctgggactacaggtggccaccaccacatccagctaatttttttgtatttttagtagagacggggtttcactgtgttagccaggatggtctctcgatttcctgacctcatgatccgcccacctcggcctcccaaagcgctgggattacaggcgtgagccactgcatccggccagattccattttttattaaatcacataatgaaataatgctggctgtgagttatgatgaccataaaccaaatttatttttcaggtcttaaaaatatgatacaccatggaggttctctgaaggggacaaaaagcatttctatcttttgtttaatgttttcactaggggcaaaaaagcataacacctatttaagactcaatacatcaacctttaagagattcatttaatccaatgagcggaaggtgacttaggtgaggcaggtgtcctggtagagagcattccagcagcagataactgttgagtgatcactacgttccaagcactgcacaaagagtggtgcataaatgttattcatttaatccaaaggaaaaacctaaaaggtgttattatcttccattttctaaatgagcaaatttacaagactcaggcaagctaaataacttgccccaaaacacacaactgtgagtcattatataaggatttattccaagtctatctcaatcccaatcccatgctcttctgaagagaatacactgctaggaaaaatgccttaaaaatcagtaatcatctgtcaaagccataggaatgtctgttccctcttctataccttctctacaccttccccgtgcttggcccttctcccatctatgacactttttctcatataagcaaatccaggataagtttcaactgataacagtgtttgagcgggagagggctccaatgtgtttgcctctggttctctccacagtatagggatggacaggaatgagggttatcccctagcaggatgctgatccttgacatctcgtttctccaggtaggagtaacgggaggcggtttagaatgagaagctgaagggaaagaaagtggtaaggatagcagaaaggaaggcaagagagcctttgggttctttcactgctggctctcacattctccaataccaatgaagttaatgattaaaaaaagttcaattactaataatggaaaagtgatctgcagactcacatcaatccagctccgcattgctagttatttttgtctgaaccatttgcgttttatcacccaaactcaacatatctctctccacataagcaaataggagagaagacaaagttcttacatttgattccataatacaaggggttcaataaataatgggagtcagactggattactaacattacatttccctctagaagatgtttttcacttcatcatccacattccaaattgtgacattttaattatcataaaccaccactttggaattaacatgaaatactatttatgaacttgagttgaatttgaagtcacgatatgttaatgtgaacttctcctaacacatttttcttctttgaatatggtcactacagatactaccatttaccaaaagcacacttacagagccaatattttccccatcaacatttctctgtcttgtttgcccaccgaatcctgcctctaattaaacaaacatacacctcaagagtcttctggaacaactgttcttggcatactttctgcctacttgaaattccaaataaacgtactgtggtcattttgagacaatagttaaaatataaaaatgacataaggcatttactaaaagaattataagaggcatgcaaacatctagtggactcaaggaattaggcatgttggttttttggctttgattttggtttttgcagtataatagccatgggctttttaaaaatgtagtaaaatatacataacatgaaatgtaccattttaaccattttaagtatacagtttggtgacattactgaattcaaattgttgtgtgggcaagatggttttcaaacatatttcttgatttactttcactgtataaatcatccatgcttaatacagaaaaatacatacataagtataggcaaaataaaaatactcataatcctaccattcagttataaccattattagtgtttgaatacatacatttttagacctattctaagcactttttagaaacaaaaatgagaccattattgatgatattatatgttttggatattttccatttcagtaaataaagatctacatcattatatttaatagtggcataaaactccattgtactcatacaccagaataagcagtttatttatagtcataatgcatgaaacagaagtaaattactcagatgtacacaggatatttaaccattcattacataacatggtaaaatctgaaaaataattatgagattttttttttttttttttttttagacagagtcttgctctttcaccaggctggagtgcagtggcgcgatctcggctcactgcaacctccgcctcccgggtttcaagcaattctcctgcctcagcctccggagtagcgaggactacaggcgtgcgccactaggcccagctaagttttgtatttttagtagggatggggtttcatcatgttggtcaggatggtctcggtctcttgacctcgtgatccacccacctcagcctaccaaagtgctgggattacaggcgtgagccactgtgcccggtctatttttaagaaaagctatttatatttgaaacatgatgaaactgggatttgataacaaaatttttaaacaattcaacaagaatgtacattagattgaaaattcccttaggggaaggtccatactatttgatttctggtactatgcctaaacagggctggtctcaaataaataaacagaatgactaacatactgccccaatttatctgtgccttggctaattgaaatcatgttaaaaaatacctaaaagataatctacccctaataaaataattaattcaggcaaaaatcaccaatggtaaaatcatttggtaaataactaattaagactaaatattgcatagtgccaacatgtcaaaccacagattatctggtaaccacatgagagaaacttagtttataatgaagagatgacactgtcaccaccgtaacccagtgaacaatgatagcattactaagagctggtcaaccaaatactaggtacctcttgacataacgcaatatgaagtacacagactcacgaaggaaacaatcttgataaaaattctgaatatgaatctgatggaatccttagatctaacttccttttacagtaaatacagaggtagaggaaaagttaaatgacacctcgtagaaacgatcagagaattccataagacagaactttcacaggacaaatgaagtagtctctttaataagtgaatgtacccaaaagaggggtgaggaaggtagtctaatactctgctggactagtagggacttaaaagatttataaaaaccaaatgcaatgcgtggtcctccttaatgcattctggtctaaacaaaccagttttaggcaacaagtgggaaatctgaatatgaatttgtacttggtaatactaaagattagttttattagatgtgattgtgatacagcttttaaaaaaattttcaattcatgaagtagatgtgcaggtttgttacatgggtgtattgtataaagctgagatatgggcttctagtgaactcatcacccaaataatgaacatagtactcaataggtagttttctggtccttgtcccacccttctcctttttggagtccgcagtgtctattatttccatctttatgtccatatgtaccaattgcataggtcccacttagaagtaacttacaacttaaatgcctcgagatttccatctgtaccaatgagacaatttctactcacgtatcttcaaagtagcttatcagtgcatacataccacagtgaaataaacaataaacatatacaaagaccaagatgcagattcaaagtcactttttttttgagatggagccttgctttgtcatccatgatggagtgcagtggcacaatctcggctcactgcaacctctgcctcctgggctcacgccattctcctgcctcagcctcctgagtaactgggattacaggcgcatactaccacgcccagctaattttttgtatttttagtagagacggggtttcaccatgttagccaggctggtctcaaactcctgacctcaggtgatcagcccgcctccacttcccaaagtgctaggattacaggcgtgagccactacatccagcctcaaagtcactctttaaagcacttgtattaaatgctgctcctcttcccgctaactgccccattcctctccttcgttttgctggtaaatcactcaaaataatctacaaggctggcctttgttacccatgccttaaccaattagctaaattctggtttccaccactctactgcagtctcctttttatcagatatattttccttgttctcattttcatttctttgcagcatttgatgttcttggctccctatcctttgagtcccttttccttgacctccatgacactgacttgcctggttttactaccatcccataccattcattagtttttcttagggcctctacttccaaagtagaggctcagacctttaccttccaaaggctcagacctttctgttatgcttttatttttgacattttttcccatagtaaatctagacattaattacacaatatttgttaggtacccacagtatatcagccagtaacctaggcactgaatagcagtgaacaaaacaaggtgcctattttccataaagcttatattttactgaggggatgagtagtcaaacaataaacaagcaaaacaattaatttataacatagtaggtgcttataaacaatatgaagaaaaataaggcaggtcaacgagttgaagtgaacgggaggtgatactattttcgaaagattaatttaaaagggtgtctctaatgaaatgagaggccaatgcagattaccttcgggaagagtaagttacacagaatgaacattaagtgcagactcacagctggagggattccacagatggatttgtgaaacagcaagaagcccagtgtaattggagtcaagtaagttaggaaaaaaggtaggagatgaggttagaaagatcttcaatgagttggtaaggactttggatttaattatagataggctccccagtagctctgcatcgactgacacctgatgtctgatgactctcaaacctgcttcttcagtcacggcccttctcatcaagctccatccccatatggcaaaactagcatctcctttgatgccctatactgcctcatcctcaagatatccaaaagggttttgtttttgtttgtttcagcttccaagttgaaaattactataccagtacagtttttctattttatttccatatcatcttcctaatcacccaagaaacacttcctcagtcatctctggctcgtccttctctttcagccctcatggctaagccaccaacattcatgttaacagtttgttcgttatgactcttggaatcatcctttttttgtccactgctgacacccaacccgggaacttactatcaaaatcctcatcactgaaatgacctcttaggtggtctcccttttctacccttctccctaagttgtcctacatactactagtaagatgagtcctacccaaattcttaaactgtatgtcattctcttcaaaaatattttcctgtctgcaggacaatgttcaaatacatttcttagcctgactttcaaagctattcataaggaagccccattaattaaaacaaaaagtttcaaactgtattcctcactgccaaactataagtactttctgctaataaacatgtctcttcactgtcccctaaaaattatctgattattattaacttcaggatttaacaactcatgctgtttctctcacctgacacatactcccttcctttttacttagattctagtcactcaagatcttctcttattccaactcatactctctatccctgaagatctactacacttatttgtatcccatatggtggtacttcatcatatgctgtgatttatttgactgttttgagtggaactccttaagtttcagggaatttggaatacttctcatagttcttttctattcatcaaaatctaagcacatacagactgaattctaggaaaagcttcaggaaacatttcagaaacaatataatttctcacaacttatttttttctcataaaatgtatatttatatatttcatatatatgaaaaaatatatttttcaaaaaacatacttttcaaaaaatagatatttttgaatcctaatcatatttttgattttggagcaacagctctaatacttgagatatttttttttccacaggaaaaggtgaaaggagtagatgtaaagaataaaggatttttcccccttggagaaaaataaaaaggtaggtctacttatccagagtaaagcactgtccaaataaacaatgaattgtggaggattataaacaaatcaagtaattccattaaaatcaactatagagggtaggtgcggtggctcatgcctgtaatcccagcactttgggagactgaggcgggtggattacctgaggtcaggagttcgagaccagcctggacaacatggagaaaccccatctctactaaaaatacaaaaaattagctgggcgtggtggcgggtgcctgtaatcccatctgcttgggaggctgaggcaggagaattgcttgaatctgggaggcggaggttgcagtgagccgagatcgcgccattccactccagcctgggcaacagagcaagactcttgtctcaaacaaacaaaaaaagtcaaatatagagatagcctatcagtcattatcagaataccacctctttggaaagcactctctaacttctttaaactttaaggggaaggtatagatgtgttttctttgccttcaggaattctaactccaaataagttagcctggctttgaaagatggttccaaccacagacataaaaaggcctcttgggtatttactacagcaacaacaacaacaacaaaaacaataaaaacacttcattttaaaatctggtttgatagatagcaagctatatgaagtaaagtaaaagaatcagctccttcactgatctctagaagaatggggggaaaatctcatcttaaatctctgccaatttaaatcagtaggaaaattttgctttctattatatctttctccaaaatttattttttaaatagtaactactaagtaattatcttagcatattatcagttgattcactacattaagatttcacatacattattcctcacttaatcctctcagctgagttctaaagtatggtcatttccagttcacaaattttttaaaaaggaagctatttaatgtctaaatcacttattcaaaatcatcaagccattaatgtggtaaaactgagtctcaaatccaggttttctagctctaaattcatgtctctttttgtatcacatactgtttttaggatggatgttggttgtttatgaaaggaagtaaagttttctttctttctaataacgtttatacacagtcaactcttggaaaatacaggtctgaacggcacaattccacttatacatggatttttttcaataatagtacaccaaatgtgcctatctctcctgccttctccttccacccgctccacatctcttcatctctgccacccgagacagaaagactaacgccttctctttctcctcctcctcagcctactcaacaagaagacaatgaggatgaagacctttatgatccacttccacttaatgaatagcaaatatattttctcttccttatgattttcttaataacattttctcttgcttacattataagaatacagtatatagtgcatgtaatacacaaaatatgtatcaattaactgtttattggtaaagcttctgggcaacagtaggatattggtagctaagtttgggggagtcaaaagttagaacaaggatgtttgactacacaagggttgaagcccctaaactttgcattgctcaagggtcaactgtatttcactttctagttttatgtgaataaattgatacaaacaggtgatagagaactgaaatatgttttctcccagagaaaactgaccaatcttttatttagtattcatgcattaaaaataactgccatcttcattgacattatatgtaaaagcaccaacaagctctgatcacataagacaaagttctgtaagtgacagataagttgtcaagtaatattacactgcttcaggacttctttatagaagttatatttaaataatgtctttctgtcagtatcagattattggaacaaggctgagaacacatttaaagtgttcattggccaaaatgttaaaaacctaacatgaattaacatgtaactaaagttgcctggagtctaatatcagaatttattcaggcttgtcagtctaagccaactttgctgattccttagtcataataaaataatctgtctataaaaataaagacccatcaataggtaaagaagagagatggaacttcctagaggcatagaaatatcaaacaatttatgaggcaaacagtaaatctgtaaataatactgtttaacaaaaatattttaacaaaatgttacacaggactaacgtgaagttcaaaggaaacaatgcatatgaaatagtgctgtaaagattattacatgtttatttttaattatcttataagaacaccctatagagacagaaactttatcagtgtgcttttggaagcaataactgttgctggttggatgattcagttatcatgaactattctggcaggtttcaaaagcagtgccattttaaaacattaaaaatgtctaaaaatgcaaccatagtaatagattctgagtgcatgggttggggggtgagggagaaagacaatgacaaattggtccaaaaggacactgagacttcatagttggaagactattgtgctgacaattagtaacagaggaagcagagcacaaaacaaatgaatgaaaaaagctgaacttgcaatgaaagaccttattatagttcagaaacattattgtaataaaggggcaatgtactctcctctataaaacttccaaacaggcaccctagtctcttttctcttcccctgcatttcattttttcattagcatctgcttgattatgtattatttccaacccaaaagaacgcctctgtatctttcctaaattccaaggcttaaaggttcttcctcccaatgtggccttaggcctcatttaactttactcaaagtataataaacgcttttaaattaaaataaagatataggggtgaaaaaatcagaaagccaataatttagcatgtatcaactcagaggaagcaacaaaacatgtccctcaagttcaacttgttaaaaatgcaatgattatataacttactgcaaatattcagatgattctgcctctaaaaaaaatcagtgtctcccctatggcttctatgacttagttggaaaagcaatgctgaaatcttcacatactagtgaatcatctacattaagctgctgtttccctaaatggaattatccaaaagttctcaaatacatcttcatgtattagtcaagaatgacaagatctgatccatgatacagacagacagactagtctagaggcatggaaaacccatatcttctgaattgcccacactggaaaacctctcacctcaaggccctactgtaaggtagtcagagatccattagttaagtaggaatatggaaaaagcactggtctggaaacttgaaagctgcaggtttatctcccagctccatctctgaaagaattccttgccactgggaaattccatgaacctagtttctccagctataaaatagactgtttgtcctccaaagatgttagtaacattaaatatatcttactaacacacacatatatgtgtatgtatgtacatatatatatgtatgtaaaatacgaggcagaaggtactcaacaagtggtaatttattactatactactccacaatatactcaatatttcaagaaataattatctgctgctgataggcaaaccactgaatttagaattagaagaaaggactttagagatccttcactctaactccctcactctacagatgacaaaattctgagtcccagtatggttaagcgactggctcaacattacataataaaactctatcaaatttatcagccacccatctacgacatctatatttgttcctttgctctagcagaaagaagtctcgctattatatataatacaactcctgacaacaatgagagtccactattaacccactgggtgatacgtggcatagcacgaaagttctatgggtgctgacgacgtattacttgaagagagctgtcatctctgaacaccatatatgattaaatgcattcaaaccaggtgttagagttcaaatcacagttctgccacgtacttgctttgaggttctgggcaagtttttcagtctctctaggtctcagattcattatctagttttttttcctttaagtaataatatttatttcatgtttttcatgtgatgacaaaatgcaattacacaaataaaacaccttgtaaaaagcaggctctttaaaaatgttaattttcttcctttacttccttaattgccctcctaatttccgatgtattaattataaaatgagattaaaacaccaaatataatgggcaaacaatcatctttctaattacaatttcaaaaactagttacgcacaatcctctttctagaaactataaatttaagtttaaaatgacacactaaaaaaaaaattcaacaagtaaatcaaatagttatctacattcaacttaaccaaaataatctatacgtttaataaggtcataaaaaaattatacagtaaatacactacagttgccttatcacacgcaggctgcaggtggtgatcctcctaccccaccctccacttcccatccacaatactccaacttccctacatacaagaaggcaaatttttaaaaaataaatatataaagagataatgtaccaccttccaagctacagtttataacctttttagcttaaattttaaaaactctgtaggtaggattttaaaatggagtatttatttgtcagtaaaattattttatattctaccaggagaaaagatgaacagcaatgttactacagaaactacaaataaaacacgaggtaagctaacaaacagggtagctagtgcctaactgtggccctgagaaaacaatgtctgacatgattagggcattctgctaagtatttcaaacgccatatttattcctatcatttattctttttcctcatttgatatttttcactctatacagggataaggacataacataccatctggagctttcattcatttctgaagatttcatacccacttactttgacaagatgaaaagaaattcagccaaagtttctcagaaataatttttcaaattaatgctattcttgttacctggaaagtaactttatcttttgaaatcttactatttctccaaacaatctcaatgtccaaagaagcttttcttgatgattctgtctttaatgatacctctttttcctaaattgtaactgcatgtattaattgcaaaactcccttcaaaacttagccataaaacatctcaaaataccaatcccaagggtctgtggcatatttttgctactagactataaattctttaaagccaagggctagatcttgtatctgtggaataagaaaatgaacacaaaactctaggttcactctgttagacatgggttcatgctgtgggctctgccatttgccaaacagtggcctaagcaagtcatataaccactctgagttcctttaaaatggggagcataatacttacctcacagtgttgttgtgaagataaaatgagaaaacatatgtgaaagggcttgatacatagtaacgctcaaagaaaggttggtttccttatttccttcttttttcccctcagtacctggtacaatgttgagaacataataaccctcaataaaaacttcctaaatattcattacaatttagacttcctaaaaaatatatttaaatattaattttgatgactcctatgtttccaaattgtgttactttaagtcaaacacatacacacaaggtagaaaacttcaaaacacagtaggtgcaaatggttgttatttgagatggctagaaaagaaaatcaaggaaggagtcctaagtatttaaaaataattgagtgatactaattatatgtagggtattcccttacttaagcacctatcaacaagtaatagttgattgctgaccttcgaaaaagttgagtgagacagaaaggggggaaggcagatacagaggaaaggaaagagggaaaaagaaaggaataaaggaaggtggtcatgctggaatctcttctatgtcctcagtataaactattgaagctgataactacttgcctgccttcctttaaaaacaatccccattgcatcctccacctctcaataaagcagtaatctaggaagcaaagtacctttaatttttcctccaatggataggatcctcttcaaccagtcagaaaaatactgaaggattttattactttaagaaaaaacaacttctgactaaaaagggaataacaacagtcacacaggtctttctcagcctgcagcagctttgtcttccaaagcccagggtttgaagaatttggtctataccccgttccccttgccctcacccaaactcttgtctctgatccaatggtgttagatcttatttattttttttttagcaatcaatatatgttaattgaatacttttttttgtataaatgttttttacttttttttattatacttttaagttctggggtacatgtgcagaacgtgcaggtttgttacataggtatacacgtgccatggtggtttgctgcacccatcaacctgtcatctacattaggtatttctcctaatgctatccctcccctagcccccaatctctcaacatgccccggtgtgtgatgttcccctccctgtgtccctgtgttctcactgttcaactcccacttatgaatgagaacatgcggtgtttggttatctgttcctgtgagagtttgctcagaatgatggtttccagattcatccatgtccctgcaaaggacatgaactcatcctttcttatggctgcatagtattccatggtatgtatgtgccacattttcttcatccagtctatcactgatggtcatttgggttggttccaagtctttgctattgtgaatagggctgcaataaacatacgtgtgcatgtgtctttatagcaaaatgatttataatcctttgggtgtatacccagtaatggaattgctgggtcaaatggtatttctagttctagatccttgaggaatcgccacactgtcttccacaacggttgaactaatttacactcccaccaatagtgtaaaagcattcctatttctccacatcctcttcagcatctgttgtttcctgactttttaatgatcaccattctaactggcgtgggatggtatctcattgtgttttgatttgcatttctctaatgaccagtgatgatgagctttttttcatatgttggttggccacataaatgtcttcttttgcatagtgtttgttcatatcctttgcccactttttgatggggtacttttttcctgtagatttgtttaagttccttgtagattctggatattagccctttgacaggtggatagattgcgaaaattttctcccattctgtaggctgcctgttcactctaatgatagtttcttttgctgtgcagaatctctttagtttaattaaatcccgtttgtcaattttggcttttgttgccattgcttttggtgttttagacatgaagtctttgcccatacctatgtcctgaatattattgcctaggttttcttccagggtttttatggttttacagttttagggtttttatggtttttggtctcacatttaagtctttaatccatcttgagttaatttgtgcataaagtgtaaggaaggggtccagtttcagttttctgcatatggctagccagttttcccaacaccatttattaaataagagaatcctttccccattgcttgtttttgtcaggtttgtcaaagatcagatgactgtagatgtgtggtgttatttctgaggcctctgttgtgttccattggtctacatgtctgttttggtaccagtagcacgctgtttttgttactgtagccttgtagtatagtatgaagtcaggtagcgtgatgcctccagctttgttcttttggcttaggattgttttggctatatgggctctttcttggcattccctttgaaaaccagcacaagacaaggatgccctctctcaccactcctattcaacatagtattggaagttctggctagggaaatcaggcaagataaagaaataaaggggattcaaataggaagagaggaagtcaaattatctctgtttgcagatgccatgattgtatatttagaaaaccccttcttctcagccccaatctccttaagctgataagcaacttcagtaaagtctcaggatacaaaatcaatgtgcaaaaatcacaagcattcctatacaacaataacagacaaacagagagccaaatcatgagtgaactcctattcacaattgctacaaagagaacaaaatacctaggaatacaacttacaagggatgtgaaggacctcttcacggaaggctacaaaccactgctcaaggaaataagagaggacacaaacaaatggaaaaacattccatgctcatggatagaaaggatcaatatcgtgaaaatggccatactgcccaaagtaatttataggttcaatgctatccccatcaagctaccattgactttcttcacagaattaggtgttacttctttagccatagtgatgtcttcttttttggccagaaggaggccataagcagggtttgggaatgtacctcactctgtttagtcattaagaaagaatagccctgactaatcaaagtcctaggcatgaaatgaaactagaaattttcctccaaccaaacaatagtatttggcctcaactgcaacagactgttgtaagcaagttctctaaaacctttaagactctttaaagaaagctcagtaaagtggtttcctcctcactccaatgtaatttagctaaaggaggaatgattgccagttaattcagcaaacattactaagtaccttctatcttacgttaatactatttggatagcattttacaacatacaaattgttttcatatatatatatatatatatattttttttttttttttttttttttttttttttttgagacaaagtcttgctctgtcgccaaggcttgagtacagtggcatggtcttggctcactgcaacttccacctcccgggttcaagcaattctcctgcttcagcccagtagctgggactataggtgtgccccaccaagcccagctaatctttgtatttttagtagagatgggggtttcatcatgttggccaggctgctctcaaattcctgacctcaagtgatccacccacctcagcctcccaaagttctgggattacaggcgtgagccacaccactcggctatatgatctcacttgatcctcactgtaagcctgtgaagaaggtatcattagctccattgttcaaagatgagcaaaatgaaaatcagagaagttatgtgatttgcccaagatcacatagctagtaaagcagtagaacctagtcccaaagtcaggtcttctgactacaagtccaatgatgttccagtataccagatattgtaataaatgctgtgggacatttttaaaatgagtatgcatggtcactgtcttctacaagtttaccattccctttgattctaaataagcccccccattccttatattctgataaaagaggctcagaaagtaaagactgtaactaaaatgattggcttgggaatacaaatcaggaaaaggctgggagatcgtggaagctactaaagaagaggaagcaggctctaaaacagaaatctgatcagatcacctgtagtgttataatgaaggaactattaaaatagtgagattatttaataagaaactcagatgatacacatgaaaagttatgattataaaggagataacactgatgaaatctttcagagatgcagagggttgctttcacccctggcagctggatttgaaactcttgactgccgcagtcattttcattaagatgggatacactttttctgttttttttttctttccacatttgttgtacaacgtaaggaaaaagtaggaaagaatgaacgttttgtggaatttttgttcttttcaaattggagtatgatttgaattggagcctgaagaaggaaatatgtgacattgttacattatagttttcttaaaaatgatctcattttaaaataatttttacaaaggttttctccattcccaattctaaacttggtttaaggttaaattctgcaaatatctgaacataacactacctatgaaaatagaagcgagaagcaaaatttgattaaatttacggtaattcacttcttaagataaggcagctattccttacagtgggatacacctgttaacagatataactttccatttgtctaaaaatttgatagcataaagaaaaaaacaagtatctaaggtgatggatttatcaattaccttgatttcattatatgaatgtatcaaataatcacatgtacccgaaaatatgtacatctaatatgtatcaattaaaaatgttttttaaataaagtaaatcaagaaaaaaaagaaagcaccaaatcttcaagtgataaaatgattaaatgatctaaaaatcattaaaaacaaacacagggttaggaattttgtatgtaattaaacctgaccagaatatagcaatgtatgtcaaaaagaaaatgtatagaacattaaagagtaacagaaaaaaaagaatgaaaagatataggctataaacacagttattatttgggcaagtgtttaattgtggatatatattaaaaaataattcagcttttccttgtcaaaaatggagaacatctgaaatttttctaagcaaggagaacggtatttgcaaaggaactttttttggagatgaatctattttatgcattgtttccaaatattccagaaaagataatatttgaaggtaagaacttgatcaggagacttaacataatccagaaaggaagtgatgaagcactgagctaggatggtagcagtaagactgaaaaggatgaggactaaactgtatcttgctgactgactcgcagcctgtttgtttaaggatgtatcccctccactgcacactataaccaggtacatccttttaaaaaaattgaatactgatttggaaaccggatgttcaaaaatttcatcacattgatatttaagactttccataatctgattactaactctctaatctgagcttttttttttcctccagcataaattctccatccatctaggatattgcctataccattcacaaaacaagctactccttaatacttgccttcatttgtttgcttatgttgttaacctgagactgtcctctgtcttacaaaaacataatcaaatcctcttcttcagggctcatgttaaccccatctcctgagtaaattctcagtcaacctcgccaacacttacctattgcttctctcaacttctacagcagctactttctacagaattcattttggcaattaatcctatttttcctcccactgctatatgttctatgtgaatgtcttccatagtcaatgacaaattcttacatataaaaattttattatatattcctttcactatcaggtatgggtataatgatcaatcaacacttcgaaggtgaattattatgatctctcataattcatgtacatttatatagtatatatttacatagtctgtagtttttctagaattacaaggttattattctaggttgtattatctgttacacaagactaagaatcaagtcataagctttttctctatccccatgtatgtccactagaagtattaataggaatcaactgatttttctacatatttaaaatctctgtatataatatttattcaaagattttttttttttttttttttttaaagagacagggtccttctatgttgcccaggccggtctcaaacgatccttccaccttagccacccaagcatctgggatgagataaagatgtttgttagtaggtttaagtcccataattcccttacttgcaaagagagagagaaaagtcggttagagagtaaatactttggtcatgcacagtagctcatgcctataattctagcactttgggaggccaaggtgtggatcacttgatgagcccagttcaagaccagcctgaacaaaatggtgaaaccctgtctctacaaaaaactggccagatgaggtggcatgcagctgtagtccccaatactcaggatgctgaggtgggaggatcacttaagcttgggagattgaggctacagagagctgtaattgtgccactgtactccagcctgggtgacagagtgagatcttgtcttaaaaaacaaaaaacttaaagaaaaaagaaaaaaaagagtaaatatttcatcttttaaaattgtgcttataaatgcagaaataacctattttttaagaagggactgaagaaaggtttcagagaagaaaagcatattgtcagggtgggacaatatttgcagcatagaataaggtagaattctaggagaggcttcttaggacacaggctggcacttctcccatcccaccacagagaataagaaggaattgatcagaagtaggataagcccaagacataggggcaaatgcacacgtcctccatgtgggaactactcccactctggaactgagcaagctagtaaactcaagagaggttcatacaaattgtcaaaatgttagcaagaccatgactcctggacagacaaactgttttactcaaagtaaaataaaatgcagccctgagacaatgtatgtatcctatattattttttaaagtgcatgtttcttgtatatatctcaatctacaatccttagaaatccatcaaaccataattgtgattagagatgtactatgcttgaaaaaccttatttttacttacatttctacagcactacattggcacctatatattaatagttcttatgtgatccacccaaagaagggtgaacgtcaaatattgctatccacattctacaggccttgtggagtttccattctccatgtcaaaggatacctagtaatttaagtgctggaaatggggccccaaatcaggtctcatcaccataaatctaggggaaatgttataatataggggtgggggaggggagtaatatttatgtgatagtcgagacacttgagttttattcttgatacttaactactactacctagtaaggcaaccttaaaaagatcactgaatttctaaaggcttcatttttctcacctaaaaaaagagaaatctcgactagatgtttcagatgttcacttaaaaagttaagtcataaaatacaagcactaggagatataagataaataagactaagctctttcccctaaaataacttactgatcagtgaatgagacatgcacaggaacaagataaccaagaaacaatgtgttaacagcagaagataatagatttaagaagggcagagaggactaatttagcaaggaatagggatgggaattaaaatctgaattaagtcttagaaaagtatccaggcaaatagaggaccaaaggacattccaatcgaagggaacagcataaacaaagcctcagagtggaaaagcagcataggttgtacagggaattataaacagttcagtattgctgatacataattgtagagcagaagagagatcctgcaagagttgaaagtagaggccagattgaagagatctatgatgtattaagaaagctgaactttatccagtaggcaatgatgatccaaggcagggctttcacaggggaatggcatagttatgatataattttagaaagaccactttgatacccgcgtgaagaaagagtatgagtggtacaaactagaaacagagaagctagttaagaatctacagcagatatgatgaggcctcattctggggtgattatagaaaaggatcataggttcaagaaatatgcagaatcagcaggactagaaatggattgggagtggggtaaagatgtgaaggagaaaaaaaaggcatggaaaggatccatgtttttgatcaggcagagacagaactcagatactgagtacaaaggaagaaatagacaaaattatcttgagtttatcttaggacgtacctggtcaaaaaatatctaggtagagatgtccagcagccaattgaacagagtaacctaatgctcaggagagaggcctagcctagagatttaagtgtgggagtaagctgcacacaaggttgcaactgaaaccccaaaagtcaacgtgtccgcccaagagaaagtacaaagtgtgaagggtcttcaaccagaaccctgttaaataccagaactgtgcattagcctaaggggtaggggggaacaggaaagaggtatatcccagaacacagtgggagtggtcaaaaaggagatggtgatcaacagtataaaatgcagcccagatataaatccaggaaaaataagaactgaaagatgtctactagacttactgacagggttcatgacatgatctcccaaaagatagcaccttagcatttgagaaaacagcaaaagcaggaaggccattcttaccttcctctcatccttctcacgtgagacaggtcataaaacttagcaagaattttttgaccttcccctgaaataggtcataagatccccatatgagagatgcccatactatacccagagggaaggaatatccttattcctgaagacacagggacagagaaaagaatctgacaaacaagccttactaagttcccttcagtttattaccattataagcccttagtccttatgactatccacctcttcatcatccctaaacataaaaatacacaagtttggccaggcatggtggctcatgcctgtaattccagcactttgggaggctaaggcaggtggatcacctgaggtcacgagtttgagaccagcctggccaacatggtgaaaccccatctctactaaaaaaaaaatacaaaaattagccaggcatggtggtgtgcgcctatgatcccagctacttgggaggctgaggcaggagaatcacttgaacccggaaggcggaggttgcagtgagccaagatcatgccattgcactccagcccgggggacagagtgagactgtctaaaaaaaaaaaaatttatgtgtttttttgggtcttcaattccaaaggctgcattgtcacataaaagttttattacttaaatttgtgtgtttttctcttgttaatcttccttttgttataggagcctcagccatgaacctgaaatggtaagaaaagatatttcttttcccctacattagcaattaagtggtcactcaataatttattataagtagtttcaatcaagtgagtaagggaggaagctagactgcagtgggatacgaagtggaaacaatgagtataacactatctttttgaaaaatttaaatcaggagggaagcaattcaaaatttaattaagattggaagttctcaaacccctttacagttctcatactctgttcttttcatataaataaaaagcctattttggtaaaatttcattaaaacccatattgattaaatatgaagtaatatctttaattatcagaaaaatgagggatatatatatccctttggtagctacaatttgatatatatatatatatatatatatatatatatatatatatatatatatataacatttcccaacataccttagaaataccttgtaaaattatctttttaaaaatgtactaaagggggctagggcaaaggaaaaagcaatggtgaagtaaccctctcttgcaccaattgttccttccttaattcctcataaagacattcttcattgccctctgcctggaatattcttcttctctgttttaatttgcttaactcctactcactcttcaaggacctgctcaaagtccaccccacagaatcacagaatgtcagggacaaaaagggccttacaaatccactgaatccaaatgtttctaacatgctgatgaagaaactacataaagatcagagtttcagagaataatctgcccaaggtcctattacttgcagcttgcggccaggttggaatttgaactacttcttcagctagtatccatttcagtagactcattctttcctcacataactgttattacagaattgaagattgcggtaagtcaagctttagtaataatcaatttctaaaaatttatttagagtaagatccatgttactaatactttttaaaactaaggagccaacctacaacttacttgttagtttgagtcaactacctacagctacttgattatacaagattacagatgtcagatagtatttatttcatggataaataagctgactgtcagtcactaaataggatccttccccaagagtgcagcatttatttcagcctctgccagtggaagtgttggagcagatgttggcagactgtgacatacagtatgtctttaaaactcgttggggtgtgaaatttcataaggtcaaaaaatgctgcattttgatcagcagatacaagaattctgtacttttataaattatttcagaaaaaccaataacatttgctggtaaaatggataaactaaaaagctacactggctttaggtagggcatttagataatgtatgctgcttatgttctaaaagctaatttctatcactttaaagcaaatgttcactcaaaaagtctttaaaatgaaaatctgttcttaagtcaatacaaaatacaatatattatttcagttgacaatagggtttaaaaaataattttctattgaaagaaaaccattattatctaatgagcattttggtgggaaaaaagatgttttccttaactaacacacacacttcatagtgatctcatttaaaaaatatctatattaagaatccactaatataaacagagaaagcttttttttttaagttagtatccatatcgttcaaatgacttcacaaatcttttaaccctttggtttattgttttatctttttcttaaaaaaaatacagtagccattctaacccactaataagggctaacctgaattaaacaataggagtaaaaaaagatcacggcttttataatggtaaaatgaaatttgtaacattcaaagacttattttcttgaattttttgttatattattgcattttttagcttcaaatttcccttgtatctttttttcccaaatatggctaatagataacatataaccaaaatcaaaattaaggatattgtctcgttaaagattttagcttaataatacagacgagctagatcttaggcaagtttaacttagcgtaatttaaaacactttacttctaaattaacacaaagattctctaattgattaatcaatatatttgaagagttggaagagcctggtaataacataacaataataatcattgtcattatcatcattgtcatctttcagtttattttgtgctatgttcatgcaaatacaaaatttctaagtaagttttaaacatttttgttagatatttgtaaggaagaaaaatttaactacgaacataaaatctccccagaagatgatttctaatataaatcacctgtttctcatcacacaatcaaaagagctaagattatgacaggaaactgattaaagtgcattaagtaccacaacatcttataatcatgctaaatctaacaaccaagttcaaaggtccttgtttttatgttataaacaaaaacttgaagtatgtatttggggaattatatttatcacattcaagttctacataaaaatattaaactctattgcattgtataagaccaaatgttatcgataacctctatgctaagggactgaaattctatcaaagctgaaaatttctctattaaatataaacccaaactttttcacaggtttctcatatagcctaagatatctgacacataaaatcataaaaataaataaatacaagatgaatcaacaattataattaacttacttgccactgaaaagttgttgaggggataaggtaaatccacatcttgaggtttctctttatatcctatgaatgagccatctgtcttcaaaaggaagtatcttggcctccagttttttatatattctcctacatgaggaaagcacgcatgttaatgctgaaaaaaatgaacagcagcttttatgcaaaaaataaattatggtacaatatatgtcctacaacactggcctccaaaaatttagttactcaattttcttttaacttagcttacaaaagaaaatacataagcctacaattaagattcaataaaaacccaaacatgttttgtttttaatgatttcacactttgataattcatttgcaccattattccttcagagaatcatctgagtacacattttgttcagtttttcattttatcagatggttgttagagcatattttcagctgttttaaaaagccttggtaaatcatccacacagtatcaatgaatttccattaaaaacatttatcataagagaggcaagaaatagatgtttctcttccactaattgtgtcttttttttttcaaaaaagaaagaaaaaagtctattttcattaataaatcttgactgtaacttgtttaagcaacattttattgttcttcatagaaaaataacctttttgcaatgctgtacttaagaaaacgaaagaacatgggttaacagggctttcaacgatacgcaaactcacacatacacaaacatagtaactattaatatatggtacagtgtcaagaacataatagtcaataaatgtatactttattagaacttaacataaggtaccacctagccaccaaaatacacatttttagcaactacattacaatttgcttacctactaaaggacaacttctaattttaagcaacagaggtgctccatgatgctacaagagctagaaggctatctggtattgattcagttctctactggttatttctacctgctgattaaatctcaaatgcttaggcaaagaagtacaaaaaaattgcaaacagttcaattttccctacaaatcagcttcttcttgtgacccaaactcaaacccaacatctgaaggttcccctccttatcacagttaggtcaatactgccatcacaagtctctctgattgagcccaatcaactgaacccttaatacgttatatctactcttctgttaatactgtttttccccactctacacattccccacttccatcctaatgtatctatcacctccagattaatcttgtgtgtaccactttatcacttttctgctcaaaatatcctgtgactccttactgcttactgtaaagtccagtctcttaccataaaatgtaatccaaatcttttactataaagggcaatctcaccccaacatgtatttcagatgtggaatcattcctctgaatcagcaattcttaaacttcttagaatctctttatatccttaaatattacttagagcaccaacaaattatgtagatttttatctatgtttactttattcgaaattgaaaatagattttataaatgttttacttcacttgaaaataaatttattacatataacaaataacatatttttataaaaaataactattttctttaaagaaagaaaaatgcaaagaccagcactgctttccatttttacaaatctatttaatgtctggcttaatagaagacagcttaattttcttagctgttcctgccttcaacatcctgctgcagtatgttgttttggtttaaatttagggggaaaaaatctggctcaaagagatatgaagctgaaaaagggaaaaatattcagatagttatggatatcattctttgatactacaccagaattcaacaagggttagtttctaaaaggttagttgcaatgtagaacttgaaacttttaacaatgaactttctgtactattatgtgaaaatccattgatctatactggactttgaatgaatctttaacactgtctataattttataacattatgcattggtcacatagaaaaccctggcttatcgtgctatgctgatcttcctaatgttgacacatttcattatacaatcacatttgttatcaataccagtctcatgaaaaaagtaaacattggaaagctgacaagctcataacgagagatctgttttcccaaatttaatctttgcttaaaagctcaatttccatcagtgacagcatatactgtcagttgttttccttgaggtgataatactctacatgcccaagctggtgcccaccacttaatgctcaatcatgatttattaaacaaatgaataaatagaggatacgtagatcagtatcctccacataagtatgtaagggcaaaaaagaaatttaaagaaaaaagaaaaaaaagtgatgctcttcactttattttactgaaaaaagacggccctaatattaataagcacatgacttaataaggcaatttataaaactagaatgcctaatacacaattcccacgttgaaaaataaaataattccttaattgctcttattttatttttccatttcatttattcctatataaaattcaaaatcattaggtattaattctccaattaatgacatatttagacttcaaatgttgttgtacagcaataagagatttatactggtacaatatgctgtaactctgtaaaggtaaatcacaatagtttaataattataccaaaaataaaatgaatcagatccatttgaaaaatacaaaagaaaacacggaataacaccatttcttcttcttttaaaatagtactgaatacacttattcaagaaatgtaaaattaaaagaaatcaaattttcatttctaagcataatttccctctatgtacatcctcagatgaaaaacacaaaaacatcattatataaatcttgtatcttttttattaagcagatttttaaacttttaaaatattttctatgatctatagcaggacttctggttgccaaaaagctatttaaaaataaatgtattatgcatccttcaaacgtaatacagtataccaagatagtgatgtactcactcacatagaagaaaaattttaaagaatttcccttcttccttaaaaaagtattatttctcacaaactttttaaataattttaaattgatttggttaatcaacaattatactgtgatactaagccagaagtagatctcaaacttccaataaagactactaaatctattttcttgtcatttttcacctataatatgaattaactttctgagaagatgcttagaatgcattcattattaatttgttacagaggctggaccaaaaaaaaaaaaaaagacaacttaatagagcttaattccagtattataccagatttcaggtgcctagctgttcgaaaaggaactgaacactttcatctctagctcagaagttgaggcagtgtgagttcagataaggcacgtgttgtcaggttgttctaaaatatggacagaaagtcctagcttttatgaggctaagtacccagaacaaagtacactccctgccaccaatccttttaagacggactgctaaaagtcaatcttttattttaaacacagaatttgcatctaagtttacacatgatgcatcaaacccaaattgcatcatacttttatgtttatggcccataggttttaaccaatttaaaacacaacctggttaaaatggaaagtcttgtcaaaaaagaagcatttatgatgtaccaagtatcccaaagagattgttcaatggacacccaccaatatacatccaaatagtaaatgtatcgtcaagataaaccttcagcaagcactgcagtcacaactggttaagacttccaacccaacctcttccactatatatatatatatatatatatatatatatatatatatatatatataatcttcatgggtgcttccacttctttctcacactcttttgctggaagctatacctatgttgaagtatgctgttatcaataccaaaacaaatacatttcccagcaaggattctggtatactggcttctggtagtgaggtgagtggtggaccctcgaatgatgtacgcaccctaatcccaggaacctgtgaatattaccttatggtaaaaaagaatgactattactttatatggcaacacatgtgattaacaattaaggattctgagaagatggacttttcccctggagaattatctaggtaagccctaaatccaattacaaatgtccttttaagagtaaactgaacacacagagaaaaggaagggggaacgtggccacagaagcaaagattggaactatgggccaaaagccaaggagcacctagagccaccagaagcaagaagagacaacaagtgggttctcccctggagccttctcagtgagtgtgaacctgctgacaccttgatttctaacttctggcctccagaattgtggcagaataaatttctgttgttttatgccacccactttttattaatttgtgacagcagtcctaggaaatacagctcctaaacactatgaccaatggcttgctaacagagctaaaaactactacttactcattgagttcttggcataggacatgtacagattcagttagcaccttctgaatgcaaagaggaaaatccacattactactgtaaatggtagagaatcctacttgtaaattatgagggtggaagaaactgtttgctagaattcatggttttacttagtcctaataacttcagattctggacctttgccacctttcttacttcacttaataacttattccctgtagttaaaacaaacgatctcaatgattttgagtaaattttgaccatagaaaacatcctgaatttccacagctgagtaaaaatactgcattattttggacctcaggcttagtctattttttttttttttttgagacacagtcttgctctgtcaccaggctggagtgtagtggtgcaatcttggctcactgcaacctctgcctcccaggttcaagcgattctcctgcctcagcctcccgagtagctgggattacaggtgcgcaccaccacacccacccattttttgtatttttagtagagacagggtttcaccatgttggccaggatggtctcgatcccttgacctcatgatccacctgccttggcatcccaaagtggtgggattacaggcgtgagccactgcgcccggccaggcttagtctttaataacaacctgagatgggacctggtatgagtttagactcatgctcactttccacctaaaagatctggataggatattcaaataaatcatctttatcatgaattatatactctcaaaccagagctcaccaaaaagttgacagtgttcacttcctaccattcacctgataacaacaaactgtatttttacttaataatcttcaacctaaattagtccatatataaacattttatttcattattcatcaacactctactgagaatcacattttgattttttaaaagcttaagtcgtaagtgtaaaagctgaagtcgtaagcgccaaggcagaagctagaagtgtacatctctggactaaacagtgattgattaaaatgtgcaaatagtctttcatctagaataactaaggaatatctagatttgttcagacatgcaaatggaaaagatcttcagaaataattcagccttgtgacctcacaaatagatcatgttgatgaatatctgatacctttttaaggctacattgtgttccagaacctagttctaattctaacttcatgaaaggtagaaagatgtgaagtgagctgggtactggttgagaatactgcagaaatactcatctctaccttcaactgtcatggactatgctaaaaacacaatcgggtagattcactgagatgtaactaaacaaatatagatacaatccaattgaaaagaaatctataaaaccatagcactatttttcacaaatcccataaaattcatttgaaattcatttagttcatttagaatttaattagaaacaacacaatcaccattttaaaaatatgcttcttacctaagaaaaaatgcaaaaaaaaaaaaaaaagaccctaattatcaagagttgcataacaaacaaaaattctaattttccgatacaggtgctagctttttaagataccaatgctcactcaaacttgttgtaacatagtcttcaaagctaatcactgcataaggaagacggtgggagcatcctcacatgtatgtcaggaatagatgttactgttttatcataaagctaaaacaagtataagctcagctttcctcagaatgctgtattttaaatatttaattttcatgtttaatcacaagcaaagtcacaaagtttttaccatgtatgattatttgtccttatacatctctgaagaaaaaaatgtatagattacatctatacttaatgcatgcgttaatgaaaaaataacctctttcgcaatctttattatttacagagggagagagccatagaatttatgcaaaaaaaaaaaaaaaaaagctggccatactgtcaatgtgaaaagcatgtggtcacattttcagaataaaagaaattttaatttaaaccaatgctatgttgtgtaacaaaaggtacaacaaattgttgtgatcaatacgaggtcaacaaacttctcaaattagccttcagtttctttcccactcaacctcatcattaaaatgctccaggcagaacaatgtaatggttaagagcaaggactctggagtcacacagcttgggtttgaatcctaatcacatcatttattagatgcatgaacctaacctctttacatctcagggtcctcatctgaaaaacagaaatcatagtttttatccaccaaagggtttttgtaaggacataatgtaaaaagcccttagaacattacctgacatatttcaagtatttgatttggttgttagcaagtgatactaatactaataccacttatgataatataatttataatccaactacaaaccacacattaaatgttctactaatcagtactgcacttattcagaagtatttacataaatgaggcaacgatgaattttttaagtctctttggctagtgtcaggtatataaaacatgtattttatgtaaggaaatgaagaggttatccaacatctaaacacagtattaatttgactaatacttttagttcttttgaatatcaggatatcagaggggtaaactagtcttccaaagaaaagagcagaagtcagattcttctgaatttttataaatgatacacacaaatgtacagtaccataaaaatataaacattttatgaattttcaaagagcagctttaaaccagaaaaaggcagttttcagtaaaaataaatgtacatgcttcaagaaactatctttggcaatactccttaaataaaagtcttcatgagccaatttttacctaagacaaaaacagatacaatgttaatttcagcataaaatctatttaatttcatcattcacaatgtagtaaatatttagttgcctgttgacagacaccaaattttcacatatgaactacctaaaagaatatggcaaaatcttttctactaatggatttcataaataaatattagcacaaaaaatactgtatagtccataattatgtgatacatcttaaatatcagtaatcaattatagttgctgaagaaatgcatgacaataaatataataagacatttgcagtatttaaaattactgattacagttttatacagaggagtacaattagttctgagtggaagcctattcatgtctcttagagaatcaaagaaatgtgcttctcactcaacttatcataaccatgttttattgatgtcttaaaaataatcctgggccaggcgtggttgctcactcctgtaatcccagcactttgggaggctgaggcaggcggatcacttgaggccaggagtcagagaccagcctggccaacatggcaagaccgtctctactaaaaatataaaaattagccgggcgtggtggcggggcccttataatcccagctactcgggaggctgaggcaggagaattgtttgaacccaggaagcgggaggttgcagtgagccgagattgcaccactgcactccaatctcagcaacacagcaagactccatctcaaaaaaaaaaaaaaaaaagaaaaagaaaaatatcctgaagaattttgttcatattatctacattgcaataaactagcgtaagttttcaactgcacagggacaatatgaaatgtaactttttaaagtgattttgcatattataggtacttattaaatacatatattgattagattttccaactcctaaaaacctgaatttttaggttatcatttatcttttattgagtcttgaaacatgttctttccttgccctcaggcaactgaaaagtgttaaattctattctgatgtctatgcaatgtctttgaccacttgtcatcaaccagctttggatgtgtgttgatagtctgtgaaaattgagcaatgtctaagcattatgaactcctgcccagctcactcattttaaggtgctgctgctcaagaccacctagatcaaaaaagccactttaaacatctttacttagatttaagaaaaacgggctaacagttattcaatcaaaaatactcggtgagtgtcaaaatatgtacaagtactaagaaggcagcaataaatgatacaagcatagtcccagccctcatggagctttaataaatgatacaagcatagtcccagccctcgtggagctttaagtctagtaggcagctgtgagaggtggagaagaaaaggggatgagttgactaattaaaattttaagtgaaaatttctcccatttctttaaccattcttagtgatccagaatgtcatactggggatggcaatagcccctattctttggcatttctaaatagcatctcatgtggattcagaaaaaggtagtcgatgatatttgttggtttgacgtctaactgtggggaagggactgggaagaatatcagcgtaggattcttcgatttgctgctatgttgattccaagatgaggcactgcatcatcctgcattcctccttgaagcctcacaataacacaagcaaaagcaaggcaatagctttactaccctttcatctagaataataaataacacatctttacgtttcaggttttaagattattgcccattcttgtctttctcactgatttctgcataatattgattaataaggtcagatttttaaacacctgaatttctctttatggttatttcacccggtaaactctgggtcactgagatgtttgtctgctcttggactggtcaatgttgccactgcagctggccacacggaaggtgtttacaattttcgtgattttgtgttgtgcttccgagatgtcttaaaggctttccagatgtacccacattcctctgctttgccacatatgttccctcatgattattttgaaaagtatattatagtcaagaaactctcattctaatgcataatgcatgaacttgtcatttttacattaagtacagttttcacttcatcttagccaaaagtccgagaagcaatattatgaagtatagttttcatatcggcttcctaaagaaagctggggtccatgttttgctttgaagctgatgagatgatgagaaaaatacctatgcattgaataccaaccacaagatgttagaatggcaacttctctaagatctcagtatggttggtttgttagtacttttatctgctttacaattttcttttgttttccagaaaactgcataattatcatctacccttaagtattctggtatttgtttcatgatattcggtaaattgactaatcaaatccttgttccacttgtttttaggaaacattacatttttaaccaaagtgatgcttttaaattattctcttaaacacaataacatcttaatagagttacagtacccagttttactctaagagaaaagcaaggtgagtaaggaaggcacaggggcattgggtggagacacagagaacaaagcatccacacggactagccaacagaaagcatcctggcaatttaatgaagaataaacggtgactttagtttacatagcagtaggtatgttgtggagaattactcaatctgtacgcagcctcctgctgggttaagtgtgagctaagttattattttgcttacatctgcacccttgtaggctgtgaaagcagagctttctttttaaaaatctgtttactgcattagagcagagtttccagttccacacaccggatttaacacaaagtcattcttgcaccattttcaaaaagtagtcatagaattttaaactattataaatatagaccaatttaaaaatataatttcatcagaaactttaaaacttccttattgtaaatatttcccattttaccaccttatattatctaaatataatatcatacatggcatatacactgcagtaaataaccttaatgaataccaaatatggaagcagtgagtccataacgcaagaaactaccacagaggtgggcaataaccattaattcaatgactaaataaacctaccaccatttgaaataaagactatactcctgtcagaaaagctctctcaaacagagaagtctctctataacacaacctcgtatggttcaatccacttttctgttagaacatgcctgatggatatgacaaataacaataatggtgcctcactacagcactaactgggagtttgcagagaaggcaggctgtagtgcttgctcatcaggaggtggtctgtgccatctgaaaaaactctcaggtggttcaacccacccatcccactcctatactaacatcaatgctctacagaataaaaactaataggactttatcttagactcttaccaaggagtttttcctctaagaaaagtctagtagtatggaccctaaaatggcactgcatcaaaccgagagctccactattctgaggatgaatccatgcccttcataactcctctcttccctcctttgttctccttagacaatgtactgattgagtcttgtaccacagcatgttaagtggtgaaaggaagaagaggtaagagcaaggaagaaaaggaaacatgaatgtcctcagccaggcactgtgctcaggcttcacttacagagccctcttcacagcaacactgagactggtgctgcagtattctcacttttcacagagagccatgctgaggctctgagacactgggacaagctagtaaaggacagagttaagattcaaagagtggttgggagcgcacactctcaagctggactgcctgggttcaaatgccagttctgtcactcactagctgtgtgagagacagtgaatgctgtttaatctctctgggtctcagcttcctcttctggaaaatggggacaataataatggagaaataaattaaagtttgtaaagcatgtagaacaacatctagctcactgcaagcattatgtaagcatttgttaactgaataaaacatctcagagtaaggctaaggaaaccaatcaaaggagatttagtgagtacctaatatgtacaatatgttagactacacaaaagtaactagagtgtttaaaataaaatggaatttctttaatttgtctagactatcactattgcacattagctgagcaaaggaggtattgattttttgtggataaaatttctatttttgttattcactttgcttatgtcctgtcttcatccctcattactaagaataatgaactgagtgtcgcttatgtttaactcattgaaatctctagtgaaagactgacaataccaactgtcacagaaatcatctttcttaattcaataacaactaactatagggcaaaaaaatcaaaagccttccactgaatttactactaaacattgcaatgtttctttcaaattataagaaagttactccatacaaaaagaaaaaaggacacaactcattattctgggtttttttaattttagattcagaaggtacatgtgcaggtttgttacatggatatacagcatgatgctgaacacctcattattttgacatcaggccttccccactcttcctttcttattacaaaaattaatcatcatctaatccccaatattctgaattcaaagaagtgttaagtcacacatcaatatcaggtctttacctctactttaaaaacgtatgcttttataagtgcacaggaataagtgtatttcaacttctagtatatttatacatagccactgcatatacagcaaagtaaattactcttgattcatattatatttgaaagatgtgattatgcttaagtttttaaaactgaagggaatctatgcttccattttaatgaatactgctctatattaaaaagtgtggcttcaaataattttgaatactagaatatctgctatcaaagacacaaaaactaaaacgcacccgccaagtaaaatcatcttaacttttccaggtaattttcttatactctctatgaacccatctaatttgacaatttatggccagtcatgttaacattttcttagactagaactgaacatgtttaaatgatatcgtcgaattgaagggcacaaacattttaaaagaacacaacaaatcaaagaaatgcaaccacaaatcaaacactattcaattactcaaataaataattttgagtactccccaaagaaagcttatagataatataaatagaaaagctgcttctcaatgttaaaaatgaatttacttaccttggccctctgagggcagtattacctaacacatagaaatttcagaaaacaatctttacctatcatactaataaaaacaaatttcttaaaatgaaatgggcatatttgctcattatacgtacatatttctttcctcatcattatctgtacctcagtaagcataataatgctgttttcaaatgtttccagtgactttgaaaggaaagattttcttaaaaccaaggcatcaggaaggaaaatgcatggaatcatcagtatcactgaagtcatccaaaatacaataaaataaaaaagtatataagaattttacattgcataaataatctaagttcctgttttgctctctgtagaataatttgtttttaaaaactgcaggacatctaaatatacaatctttcagtaaagacaaagtaatttgaggaggataacaattcagttccaaagtgtcttcttaaaagcagccaataccaatacactcgtttgttacaaatcactcatttattaatgaaatataatgcaaatgacaaattggcaatgtggagttgaagcactcactgagttttcataactgattcttacactaagaatctttacatagcataaggattatccattctagaatctaagtcaatcaatgtacactgggtgttttattccttttgctatttcacagaaaggaaaagttttctagcattcacttatcaaagttttttttttatatacaaaacactgagtaacttaccctatataatccagtggtatgatagacctttactttaagaatataaaaagtgctaatctttatgtcagagttttacatacaagttaattagtaactatccaactttccaggtcccaccacttctcccatatagaaaaaaaaaaacaaaacctagcattaaaagaaaaaaaaaaagagcttctattgaaggaagataaaaattattacaagcaggtaaacagcaaatttactttgacacagcaagatctcacgtggatgacactgattgccatttagtaaaaatgtgttttatttaggttttgtatttactttttcaaaaaagtccttgcttctataattcaaagtatagtagttctccactcaggaactatgccattatttagcataactttgaataaattagatttttaaaatttgaactactaaacagtcttattctttttaaagtatataatatcatggatattttaagatcataaaaatttaaattctatttaaaatccttctttactaaatcaaaaggtaaaaggaactagcttaacagttgaacatactacaaattcagggaagggaatgaaggtcattttataaaattcttttctataataaatatatatacttacgtttaaatatctcttcaaaaagatgccaggaaacaacaactgctgttctatgcgttcttccttagaagtataaaattatgaactttgatgctgtgttccagtctcaagcaaataagtgacttgcttggccaaaaaaatagacaaacttcacgatttatgcttttcctgcctttgtatcttaatcatcttctgttctaaaaagtgctaccacgtttacccacatctttaatcagatttttttgaactaaaacacattaaaaaatttaagccaaaacatttagcaagatgccttaaacaatatgtcagacagtgaaatactctgttttcaacatactggccaatatttttaaaaattgctattcatgcagtattttgatgaggcacaattcaaatatacattaaagctagaagtttctgaagttttctgaattatcctgaaaatataccaagtacggtttcatttatttgtgaaaatgtccttacagtttcatcctcatttgtgatatatttcataggctatggatatttccacttctttggtactgtaagttgttttttataaaaaacaacaaaaattatttgtttataaatttagactgtaacacttaactatctgtctagaaatactggcatccatcaccatgtgccattaaacattaaaatatccttatatgaagctactagcactccattcaaaagtgagcgttatttttctagtgtaaccaatttattcttttaaaccaaaatagaagttcttagtcactataccccgtcctatgaaagactcttaaatactaaattaggtggctctcccaggtacaacaacccttgactcatcatccaaaattattcagtaatatttactagcgtggaatgccggatgaaaacaatttgaaaagaaaaatgtaaagaaccaccacctacatctgtatgggaattaatcatacttttaggtttactgacttcctcatgtcgaccaaagccatatcctctttacttctctaagaaaacacttctgcttatctcagcactttcatccctatgtgagcttaattagtttcttcatctgcaaaataaagagttgtgacaatcaaataatgctttaaacctccatgaggagaagaaatattatttttagctaggtgttccaaagtctcattttaaagataataacccaaatacagcttaagtactggccgtagcagagaaaagttcagctccaaaataaactgaggttacttttttaagtatgaaaaataattttgtagaacaaaatgtgaaatcagctggccaggcacagtggctcacgcctgtaatcccagcactttgggaggccaaggcgggtggttcacaaggtcaggagttacagacaagcctggccaacaaagtgaaaccccgtctctactaaaaatacaaaaattagccaggtgtggtggcacgtgcctgtagtcccagctactcgggaggctgaggcaggagaatcgcttgaaacccttgaacccaggaggtggaggttgcagggagctcagaccatgccattgcactccagcctgggtgacggagtgagactccatctcaaaaacaaacaaacaaaagaacaaaatttgaaatcatcatcactaaataaccactaataccatacatccgaaatacttttatccaactgttttctttatattttctttaaataatttatttccctccacatttataaaacaatcatatatccctaaataaacataaggttccaagaaacaaccttctatctgtgaccattctctcaaacagcctctacagcttggtattcttattctatgatagtcagagcattatataaatactccaattgtaatagctacagagctctagacttgcacataacacctaataaaaatactaacagctactactgaattcattcaagacattctaaatatattatctcattttgttttcacaagatccttgaatagcaagtattgtttccttctttcaaaagatgaagaaattcacatttaaatagtttaagtgactatgagtaaattcactcatctaagttaagtgatatttaaatctggtctttgtaacttcaaagacattctgcctttaatatttcaatcaccttaatatgtatacttgcctgtactactaagatttagcaaatggctctgaaagaatcagaagtaacatatcattaataaagcatagacctgcaagtttgcttgtgtataaaagttggtataagcttgcttttcccagtcactcattaatatcctgaccactgacaaaccataccctctcactttaataacaaacaccttctacttaaaaaatggcatactgctcgcctccaaacttggtagggatattaggattgactatgaaactgtaaatacatggacataatcctacacacaaatatggatatattcacggccacctatataaaagaaataaatacatgagacaaaggaaaagtcaaggtggctgatgattttctatgccttttcagcaaacacggattagagtcacttgagtaaaaactgacggtgagagagaaagttttttctagatagacctgacctctatttctttatgaaaagcagaaaataacagataaccttcctttaattctttcagaaagacattactctggacacgaagctctgtcagtacgttggcctttcaaccatgctttgggcaatttctgcttgataattatgcaacaaaaccttaaatgttttaggaaggcatgagttccaaaagtcaacataagcactttttaattctccacacatatttttttttgaaatgttaagtccacattgggcggaaaaaagaaaaaaggagaaaagtcagagcttctcttttttgttttctagttattccattcatattgattggttctgaaatgttacaaaaatttttggtgttctagaaaataagtaatatggaaaatttttacctaaggtcactgtttcttctcaattatttaaggtgaaagtaataaaccagacatttaagtaaacatgctcacttccatctaaatataaatgttatcacagcatttgaaaacattccagatatatcaaatctctaacacctaatgtcaagaatgtatcagaaggaaatatacaaccaactcattaatgcttgataaaaatgcacgcttgtcatttatagaatccatgacaaccatgagaaaaagagtatgtactgatcaaaaaggccaggttactatataactttgtttcacaactaacgacatttaagttcaaagtattatggaattacttacaaaataaactgggtactctctacctcacccctagtggtaggctatgaaacaaatcgattcagtttaaaatagtttatgtgccgactagtgttaaaacgttcatgtatgcattaagatcacaccaaatcacctgactgattccttcatcaaaagctcctcttggcagttagcagtacacacctaacattagccaaacaggttatctaccatcaacacggagaaataagaaactttgtattgccatttaaagaagttgctttctaaaactagacatgaataagggagagaagaggaagtattaaacccctaaactaattaacgaaataagggaggggggatgcaggaaaacaatgataattagtatgtacccttggttaaccaaatccacacatacattcattctgtatatgcacaaacatcagcagcatcataaaccgtctcaagttctagccattattcagttcgacatctgcacatgtttatgcgtctctccaaacaacctcttgaacaccctgctggagctgtcatttttttcttctccctatctggcagatggcaagtcaacaatcggcatcaacagcagccgaatatctccccctccatcctacccccctaaacagacacaataataacttctttgtgcttccctacaatgcagctgcttaaaccatttcgctacaaggctgctttgccttaataaaaaaaaaaaaaaaaaaaaaaaaaaaatcccttctgtcaagtctaaaaagcagcataatgttaagcaagctaaagccacagcacagctgcaaacgggcagacacattgacagctcctcccttaacaaagccctgtgaattgaagggggttcatctgaggctcacacagtaattagtataaaaaagtccgacagcctctattatgctaagggaaaaaaaaactggacagaactgggctgctgttttgcgtcaagagttctgctgcagagtagataaatcatgttgggttttttcctctctttttaaagacagtaataaggaggatgagagaagctaatttgaaaacttggacacagtaattgtaccatatggtgagcatttatcctttctgaaatgcacgctaacagtcacttacatgcacactgctttgttttacagttgttattctctctaccatattcataaaatggatttgaatatctgatactcaagataagttgtgtgtaattagcaagagaactgcctaggtttaatttattggccttgcactgcaatctagtaaaatgcaaaacaaaattaaacaatgtgtccactttgtacagatattttttctttaactcaacaaaacactaatgaatacaagttcattggagtgtttctaagttaaggcacagtgtattttgaaaattccaacagaataaactatagctgttgataagatttctgatatgtcaccataagaataatttttcagaaagatcacctggtttaattttgtatttcactgaagcagatgtaactcttcctcatatacatcagtaaacctagatgcaagagaaatttccttgcatatgtcctaaaaattttaggaaaagaaattctgtcatttattaaatagttattaagtactctgtgccaagcacctatctggcacggggaggagaatatagaaaagctttcacattttttttaaatctaaacataaattgacttattttgtctacttcaaaattctataaaaatctactatttgaagaaagactttaataacactaatagtacactggttatcatggcacaatatatatcaaaatatatagggaacaagattagtttaatcagaagtaaattcactgtaatgacatctgtgtgacccttttaggtaaaatattctgtgtttactcaatataaactatgttctaaaactgacatactcaactagaactcatatgaatcctttaaatttcaagtggagtaaaatcactggtttgaatttctacagcatccatttgaccacaagtatccttctgatcaatattttggggacatgaagaagcagaatattttaaggtattgttagttcaagacagaactaagagtccctactaaagcttgaagtaatctgtctttagaagaaagactgtgactccacccaggaaattgggcataattacattaagaaggaatggcttcatccagaaagtaccactaataattttctacaataaatctccattttggcttaacagaaataaacttggtcacccactactagtatagtggcttccctttatgctactggtattgggccatatgaccaatttacaccttggataaaaatattcacttttgtatactgctttacagtttaccaaatatttttaaatattaacatgggtcttaaaagttcattatactgggccgactttggtttcgacatagacagatgttttgattgagaaatatgtgaccaacaacagaagtctgattctgcatactttcaaactgggtgaatcctactgtattaacaatgtcatgatactatctggtgttaaacaaaaaatgggatcattctctacaaagtggagagagatcattctttttctaaaaatctgcagaaaaacattacataataactcttcttgttaaataaacgagggaaagaaaaaaagtatttttagaagagaaacttttcattattttgaaaacaggttcaaaggtgttaccaaatgacttatctttttatcacatatgaataaaaagccattcttagtggagaaaaaaaaattgtttccatttaggaaaatcaagttgaggatatgtgtgtacactgaatactccatttagtgataatacttagggtaaatgggatgtgaatataagatctgaaaatttaacagaataatgatggctttgtccaggaaaggtgttgttacaccatttgatcaaaagtttttcttagttaagtctgtcaacaatttctgaactacctgaaaccattttgattatatcaatgacaacactgcagaaaaatttgtctgtaaggaaaaattaagactgttttaaaagcttctaataagaaatatttgccaagaatacatgatttttaagaagaattcttcttcatataatcacaattctgatatcctttacctaaaggggaatagggataattaaattagaacaaagctgtaagaaaatgttcataaataagaattacagaaccaaatgatcctagtgggtctggtaaacattctcatttttatttacctacgttgcatcttttaagagctcatatctgccacaaaagtaacaagttgctgttttcttattaaatgtgaataatttctcataagatctagcaggtaccaaatacaatttaatttataatgtatggggtattattaaatacttgcaaatattaagtcaaagactgacataccactaagaaaataatgcagtggtctattgatacactaacaatgatggcaaaacctaatccaagactttgggatgcaaaaaacctaacatatggatatggacttcctcagcagaaattcgagtaatgcatagtttaaaacaaactcttcatttctataataaacacaaatcaagcaatgagaatacctaacatagaattttaaattcagaaagacaagaaattaaaaaggattacttcatattttataatgatgttgtggaaaaaagaacgaaaagaggagaggtcatgtctagaatagtattcagaagcaggcctcagccaaatatttacccctgatacttgtctttaaccttagtgctctattagaactctttcagttacaaggaacaaagatccactgaagctaacacaagtaaaaatgggtcattctaataatactaacacttcatccaaagaatacaggtagcccttttgcaagtaagatctggaaggtgattaaatcactttcttttatcttcttcagggattgtgtcaagtctggcttctgtccctggtctctctcccattcccctcccaggcctggatggatctcagtctgtctgctccatcttccacactctacccaccagctccttagctcactcagaagtttttttccttcataaactcagcttgctgctacctcttccaggcaatgctacccatgacacataatacattaaagaatgtggtttagtgttactttagaaatgtttaagtaacttccatataatttcaatttgtattaaagtcttttagtatactaggtaatcgaaatgtcttcccaagagtcatacccagtggcttttaaattgtgggtcaagatttttaattttcaaggactaggtagtatcaaaaatactggaagcactggcagactccacctgataaacaggctgggttccaatggtcattgtcagagatttaaaatttagtttatcattttaaaaaattattaatacaaatggtaactagttcccacatgtcattagttaaaaaagcactgtataactactacttgctactttaatatttgctttcattctccttacttcatatgagagacaagtcagatattaatattaccatcagtattctatgctcaagagtttcaaagctataagcacctgattaaagaatgagacactgagcaccctatcattggacggccacatatcaaagatgttataaaagaaatttgagttctgagttaaaggtggtatcaaactgccccataggttacttttaacaccaagattctagtatattggtgattttacagattaggaaaccaagatttcaagttaagacacatgttattgaactagttcttttgacttcaagtccagctaatttcgatcataaaacatacattgtacattatacttgtaagaaatcctggaatctcaaattccttttaacagtacttttatttttaaaataaattataagttagaatccagttatgctgaatatgcaacatttctatgattacacccattaaagtatgcaaataagagtaaggtcaaagaagagagctacattcattttacattggatgctatgcataagaaaacagaggacctttccttttcaagtagagtagcaattgctcctaaaacaccacccaaggctcagctgaggtggtctcttaccatttgtttagaagggaatctgatctgtagctgaagcaattatgaacaggaggtaagaaaatccccatgtcttataaccatttccaacatacacacaactggggacatggatgtccacaagccaacgattgtatgcattctctgtatcgttacttacataggagatgaaaattggaaacatcaagtgagtcatgtagtgtatttttaatttataattattaaatcttcactttaaagttttttttaaaaaaaagctatctaaagccacaaacattttacctatctactgttttgttttgttttttttcagacagtctctctctgtcgccaaggctggagtgcagtggcatgatcttggctcactgcgatctctgcctcctggattcaagtgattctcctgcctcagcctcccgaggctgctacccttacagctgggattacaggccctcaccaccacgcctggataattttcttttttgtattttttttttcagtagagacggggtttcaccgtgttagccaggatggtctcgatctcctgacctcgtgatctgcccgcctcggcctcccaaagtgctgggattacaggcatgagccaccgcacccagcctcagcttcaattatgaagagtaaatgctagcaaaatgaattgatgaattttttctttttaaatattctatccaatattttgcatgtccaaaacacaaggtaaatttcacctatatttaggtgttgtagaagtccaacaaactggatttcatatatgcacaaaacaagccataatccaattattttcatgggataagtcattccctaaggggataattcccttagggataattcccctaagggaatgactcattagggaaattattcaagtaatgaatctaactcccagcaaacaagatatataaggtatgcagttctattcatttaaacattccacctttttctgagtatcacatatgtcaagacagtcattgcaaaaacatttgcaagctgcatgtggaatgtggcaaaattcctttttaaaaaaaccgatagtgtttaaatcctatcccaactctcagagacttttcttatttcataatgcccccctactcctacaactcccaaaattactctaatttattcacataactctctgctaactttaagttttttgtatcaattccctaacaaaacattccaaattgttctatcttttattcatctcatcgagttccacaccaagtcttcctccaactggagtcacaccccaatttctcactcctcagttcaactttagttttcctgactaccaattccaattgctaagaaatgagaagtatattttgagtaaactaaattacatactcaaatcactgttgagtgtatcagtgaaggtaatgctggctgctgagagaggtaaatcatgacaacttagtgctttactacaatgaaagttttgtttctggctcatgtaaggtcaaaacaatgtttcctttcaatggcagtgactgaaggacctagaatcctcccttttagaggctcttccatctccttggtttcatgactgccatcagaagggaagagagaaagaacactgaacacagatgttcatgacccaagcctagaggaggcatgcgttaattctgctcacatgtgagtggccagaactcagtcgtatggccacacctaactccaagacagctgcaaaaaacagtctagattggtgctagggcagagtaggtgtattacgcgcaaacggatttggccaatctctgctacactgaacatctcttgtatgttcttaaatacttacttaataaccttggtgttaagagagagacataagaaatgaaagcaactgtatatctaaaaatggtggccgggcgcggtgcctcacacctgtaatcccagcactctggaaggctgtggtgggcagatcacctgagatcaggaggtcaagaccagcctgaccccatctctactaaaaatacaaaattgcccggagaatggtggcacatgcctgtaatcccagcaactcgggaggctgaggcaggagaatcacttgaacccaggaggtgagggtgcagtgagccaagaccgtgccattgcactccagcctgggcaacaagaacaaaactcaaactcaaaaaaaattaaaaataaaataaaaataaaaatggttaaaaatggttaaaatggtaaatttcatgttacatatatttttgccaaaataaaaaggatcttaaaatctttttgatgagaccaaaagacatagtaaaaaaaaaaaaaaaaaaaaaagttctaaatcaaacatgagcaaatgtcaaaatataattaaaagctaagtataatataatcttcatgtgttttatcaatactacatagagttctatgatttttatcataaataggatctcagcctgacttggcctgtctgctctggtctaaaagatgtgaggagaaaaaaagagacttgttaatatcataatattatcttaaaccagtaattcgaataaagagatctcctcaaatattagtatcttaaaattataaagtagataaatattaagggttaatacaatttggagccaatcaaaatgcaataatctcttgtccttttccttttattttttacgtattcccagatggtccaactattccgaaaagctcacggtatatactcttgagaaaataagcatgtaaagcattcttttaaagtacttgccacaccatattctactggcaaatagggctaatgctggagctcagaaaacaatactccaaaatatggcacttcagcacacaaagtactttgcactggaaggtatcagaagcagcctcagaacctggatctctctcatcttctcctgccctcctgtctcttgcccctcattctcccccaaagcaagtacagacaccagaattcctcctcaccaaagcagataataaagactagatctctcttctccaaagccagccataaaaactacaattactactctaaccttcccctcacctttctgtctaggaactggcctagacagaaattctgtctagaaattctctgacctacccttgtcccaataatataggtcataagaccctcatcagaggggtcctgtcccatacctgggaggaagaaacattacaagagagaggccaagaagaatctgaacagacaggtcttggtgagtttttatatgcagtctattaatattagatcataacctttttgtccagtcctatttctacatagctgtccatttttcactgaacctaagcactgaaaaatggatagttgtcccatatgtttggggtcttcactctgaaggctcctgtgtcatgtaaaactataattaaacagatttgttatgcttttctcttattactctgtattttgttataggagtgttggccataacccttatgatggggaggaaagggatcattccctttccactactatactaccaaatataaactagtagtacccttataattcttatattttcttactattttttacataatggagagaaaaaggagttaataaccctgggaaatttactatgccaatgtaatcctacctacttttagaaggtatcaaaatatttgtagaattaaaagaatgccactgctaaaaggaaacaaatttgtgtagtattagataacactcctgttgcttccaggcaaggcacatcagaggtgagattaccctacagataacttttttaagaaaagatataagtaacctaggtattataattttctagataacttttaagtaacatagacgttataataattttcaacttttatagcagatttaaatttctacatattatataacaaaatctctaaaggagccaagcataagacattccaaataatttccaaacacattttggctatgaatacatttcagttttacagtcattaaaatttacacagcttagcaggtcacagcaggtgttacgttattctcacgaacaaaagtttaacattaagaacaattcatatattttgacacatctgctatatatattcgtgttgcaaggactagactgcgagcttaaggttttattatattatgcttacatttgaactggttatcataaaaaagaaacattatactataaaacttcagagaaaaagatatacattaaaatagcaacaacctaaatttactctataatataaagttccatcaaagcagctccatctaaatgttaacatgtctaaatattctgtgcatgcttctgagtacatgcatatgaataaaatgctaaggggaaaacaacataattgccaaaatttgttttataaaaggcatttcccccatcacataacttcaccatttctagtaatcatcacacccccagaccaaagcacgaagttaaagaaggcccttataatacacataaaaagtcaacaacttccttcagactaagaagaacaaattctaaactagagaaccctggatgagaatgacctgcccaatccccactgaaaaagatggaaaattttttcctaaatggagagaatcacataatgattcatgtcttcaataaaacatcaactaactcagaaaaagaaataccatggcaaattatacctcaaatattatattagacatgagcaatgtaaaaacaactatcaccgtaagaaccctgtctaggaagcaattaatctttctcaagaaatgcagtaagtctgggcacccattttcaaaattatcaaggccacttttcatttaaacattaacatttattattttcatttaaaatgttcaatgtgaaattgttaatatgttaatatgtgttttaatacattagtttacaagtaataataaggtctgaaaaacaatttataaaaatgactatatgctgttatgctcaaaataaatcataaacatttttcccagctcacaccaggccctttatctgagggattattacaaagcaactaaaaactcaatcacaatataacgaaaataatgttagctggcataggagagtgttttgaagtgctttctgaatacctcagtctcacactcaaatcaggagcatctgtccaccaactgtcaagataacgtctagcctaggagttttcctgaattcatcactattcatagatgcctgtcactattcagaaaaagaagaaagaaagagccatactttcaaagctattttctttttctatatgtcctagtagaggtgaatatagaatttatcactttgaagccaatgtagtctgaatcaaccggtcctccatctccagatctaagaatgcaagttaaatgttctctagaaattatagataattcactatgtcatattaatacttctcacttatattactactgattgaaggatctgatccctagactcaaagccattacctcaccattactttcacaactagaaagtacaatccagccaccaacccctatggaaaatggcacaatcaagagtaaagtgtttccactgacgccaagcactgtgattcatgcatgtaatctcagcactttgggaggccaaggtgggagggcttgaggacatcatatgagtttgagacttgggtagagatcctgtctctacaaaaaatacaaaaaaaaattagccaagcatagtggaacctgccagcagttccagctacttgggagtctgaggtggaagatcacttgagcacaggaagtggaggatacagtgagccataatgcaccagtgcactccagcctgagagacagagtaatatctgtctggggaaaaaaaggtgttttcattggcttcgttttagatgctgctgcaaaattcaagttaaagctgtctctctcaagaaacttcatttaaaatgcattcctatgaaatttatatccttattttccgagtcagaaacaacaaatttcattttataacaaacataaataatcctcaaagtattcagaaatgcttttctgagccactgtaacaatgctgtgtgatacaggagaggaaaacaagactgtcatccctgcagtcctcaaaagaaaaagttaacaccaaacaaacaagataatacaaggtaggccaaaatctagaaaaattgaggggaaaaaaaaaaaaaagaatccagaaaaaggtaaaactacccgttactgagtatgcagttgtaccattttctactttacatactaactagttcagtcagtaatatctctatttttagttccttaaacctacatacattagagaactattaggtgagcaaatcagtaatcaagaccaaaaacagagaatcaataaggaatttagttttcaaaagcatatttttttcaaatgcaaaagtaaggaattttttcctacattataagacttatggtatcttaatgtttatttatttccataataatttaagggaatgaatcttcagtttttgtgtaaatatgacttaccatggcacttaatacaaatgcatccatcttctgggatccagacccacaagttctaatttcattttctggaaaactacacttttaccaaggattaagggggttctaatacaggtggactattgccctccctttaagaaatactaatttaagagctcagtatctcctgggagaaaaaactgaattttaaactaaaatcattcttaaatcattcagatctctggccaacaaaatactttccagtttctgagggaaaaaagatgaagaaaaggcaactattgttataaaatatcctacaatatagaagaaaaatcaggtacacaagaaacaaaagtagggttgggcacagtggctcacacctataatcccagaactttgggaggctgaggtaggaggatcacttgaggccaggagtccaggaccagcctcggcaacatagcaagaccttgtctagaccaaaaaaaaaaaaaaattaaattagcctggcatgatgatgcatgcccgtagttctagctactcgggaggttagcttgagcccaggagtttgaggatgcagtgagctatgataaggccactgcattccagcctcagagacagagcgagccttgtctttaaagaaaaaaaaaaagagaaaaagaaatgaaactgcaataagggcagtaagaaaagttctggaaagtgttgacagtttcagaaggaagagtttactttcaaatggtgacaagggaagacaagatacaagaggtgaaacttgagctataacttgaagggttgatgagtaggacttcaccagtgactagagtgagtgaagtattccatgggggcactgtgctatctgcaaagatgcaggaaaaaaaattataacaccactctccaggaatatgtgaccaatctagcagaataacagaacagaactcagccttttttgtgtctctacttcagagacaagaataatatactccagcagtaacactgctcactgcatacggagatttgcaagggttaagggtcgggggcataaccacagaaataaggtccttgtgacaactaaataagataaaatattatatttaagatcattacattccttttgaaggtcactttgactacttcaatatacagttcaaatatatttaattcttccaaaataccattgccaaaaaaaattagtgaaaagtggtaactggcttatataatttcgacgatttaatgaaaacaatacatatgccacatatacatggctaaaagatgtcacagttgattcaaaatggataagcaatatatatgttgttacaattttcaaagtaatagctaaaaagtacacacagaaaggtgtttatacacattcactcatctatctggcacttcgtagaagactaggaaagctactggcctttttaaaaggttagttctcataaaggcctagtgcaggcagctctggaatttcatgcctccaacattaatgtctggaatttcatacctccaacattaatgtctagtatgctggtgggtgctactcatcttttcaaatctgttttaattattctgttgctgggcattttaacagatcttaagtttgataaatttagaattccaactggaggttaacccacgccccaatatgtaagccaaatccatttcaattatttacgaaaggcagataatatcagaacaagactgattatttaggtattaaaggatgtataagtaaattccagtggtgaaatctggaaaaattatctggatgaagagtcaggtgttttttaacgtgtgggaaaaagttgtggggttaatattatttgatctgcttactaaatataaaaatattttacacctataaagtgaactcaattaatgcagggaacaatctaaaatatggcaaatatttaatatggttgtttggtaatatttaagttcagtttctataacttacaacaggtaaattctcaaaagaagttgtcaattttctgaaaatctcagtctgtggttgctcaacttagcaaccaatattctctttttcaacccaaaagaaagttaacatttatctatgaacaagcactcagtcccacagccatgagagttgtcaaaataacaggaagaaaaatggaccaaggatatataaagctgaaaatgggtcagaatgctcaaattaagaatcaaacttatgtttttatttttcttgctttttcttgcaagccagggcatcctcatgaaaaaacaggtaagaatttggcaagaatagggatagaaagcaaaaagaaacttgttttcccaaacatctggcatccttcaacaaactctggcaatgaaaagtcaaagcaaagcagataagattctgccaatcaccttctacttaggcagtggcaataggtggcctagccaaggctccctgcctgagctgagaagagatgtcagtattgtggtaaagcccacctccttggtcttcaacagattccttccatacccccaggttatgacagaaaatgagcaattcacacaagcataaatgtgaaacattaacatttaaaaggagcctaacctacataataagtgctgaggctgaatacacattgtgggtcaaaatcaggacaaggcagctcaacatggcatctgttaagggaagaaaaataaagggcagacaaaagacaacatttaatcctaggttcaaccttcataaatcagcatacaataccaaaagtaagttagttgattgattgattgattgattgagacagggtcttgctctgttgcccaggctggagtgcgatggtacaatctcagctcaacacagccttgacctcctgactcaagcaatcctcccaagtagctgggacttcaggcatgcactaccatgcgtggctaattttgttcactttttgtggagatagggtcttgctatgttgcccaggaaggtctagaactcttggcctcaaatgatcctcccacctcagcctcccaaattgccaggattacaggtgtcagccactgctcccagccccaaaagtttattattataaggactcttactcttcattgtaatttataggctgaaattgcaaaactgaaaaccctattcttgcaacaataacttgaggtatttagaactcatgacaccaagtttcacatcctctttcttaagtctgcagaaaaggaacctccatccttatagttcaaagtctttctagcaaagaaaaaaagagaaccaagaaaaaaaagcatcataactattttgtaagtatcaaactaaaaaatttgatataatcttagtttaaaaaaataattataacactgatttgatatttaggcatagagggatgttggtgttttataagaattgacctgactataagcagcactcagctacatctctcaaaaataagggaaagccattttaagagcttgaagtagtatgttgtagtcctatgacattaatagtttaacagaaaccacatacaacttgaagactaaaactatcaactccctaaacaactcacagtgtacgttaacatgacttgactattcagggagagcctcaccctggcaaacggtttgattgttcatcacagcaaactcctgaaacacgcatcaacgattcaatagaaagccccaacagtatgtaagattttttgaatcccttgctgttgcataatggtcatcatccaattttaatcaaacacacacacacacccagtattcactcaacctcaaccaaactttgattctcagtacatactatccttgctttcttccctccaagaaaccgccaaagttctaaccaggtggtgtactccctttctgtgacaggcaataaactctatctataggttgtgagggagacacttgggcagccagcacttgatactatgccagctgtaagttttaatcattcaggaatatagtgcaaagagtactgtgaacttatggtgtgctaatgcatcatactagcaattgtgaatttagatcataaacctttgtatttcacctaaaactttatgggaacagataggacaggacaggcaatcccaatgcttttgtagaaaaactgtctggtcatatgctgtcagttcttcacgatttcaaagaataaccacttgaaagaaaattttcaaaaatctaaagacttaataaaactaagatcaatgagttttaaagtacgtgtcattaaaagcacaaactcatttgcagtctatggactctaaggcaagagtcatatgccagacatcccagaagaggtaaaaagttattagagacaaaaaggacttcagggaaacttagtttttccttagggaaaggagtcctccatggagtcacatggccctccaataagtaggcatcaggtagtgtatcaagaactgatacaagatcagaaaggaagagccaatgagttaggagaaaccaaggttgggtttcaagaattgagttgctacttgtgctgaatgatattaagagatggagaaaaagaaagagaaaaatgttcacgcggatgtcaatgatttttactagactcttcagaggagtaagaaatccaaataaactagagtttagggcagaaaattaactacaaggtgagaatatgaaagatgccagtgtggacaaaccatgcaataaaattttattaaaagagaagcagaaatagaggcagtagcagaatgggaagcaatatgtcaagagggggcttttctttttaggatggaagatactattgcacctttatatgccggtgtgaatgataaagcagagagggagagactggtaatacaagagaggtaatgatttgagattttgaaaagattaaaagggtggaattcaaaatactagtgaaaataagagcatatgcactgagtttaaagcatgagaatatggtgagaacataaatgggtacagcctttccaggaaaaaaatcaagtacctcatagattataaagagacatgaaagtaaccatatcctttgagccagtaatttcactcataaaaatctaccttaaaaaaagatctgaaatctatcttaactgtctaatgatcagggagaactgttaggtaaataattataaaatgctattaaaagtccttaatgatatgggaaaacgttcataatattaagagaaaaaaagcaagatataaaattccaaatgttgtattttaaaaataaaaatatgtgcatagacaaaagattaaggagacataaaatattagtaatatctctggacaataaatgatagattacagtgttcttctttatgtatatttttcattttccctaataagaatgggtcactttattaccagaataatttactttcatcttgcctgtattttccaagtctctctactgacaccttcctaacagctttaaatatttgtgtatttcagaaataaaattgtgatagtggcaggaggcagacaaattcctaggcagattgggacaggtccccagtgaaacccaaccttcagggcacacacagcatgaagcctgaaaacctggctgctccttctagctggaatccacaacctggagggagaatttcctttacgcctttcagccaatgaaatggtgttttttccaggtccacccatggaccactcagcacgcacttcctcctgcccagggaccaatcagcacacacttcctccattttgagcccataaaaaccccagcttcagctggactcaaggtaagtaaggactacccttaggagctgcccgctttgggtctcctctctgctgagctgttctgctactcagtaaaacttctccaccttgctcaccttccagttgtccacgtaacctcattcttcctggacaaaggaccagaattcgggacccacccaacagtgggcatgaaaagggctgcaacactttcctggccaactcaccaaactgtggtggtgacatgctcccatttgctggactgcaggagtgaaaagcagtgacacttctgggggccgagacatcaggatttcccaagccagggctgtaacactatagccttcctgccttctgcctgcattgggcagctgccccatgtgacaggaagtggcagtggagctgggccagcctgggagccgccggctggggtgaggtggtgggactgaacaagctgaaacctgctccccctgctcgccgagccgcgggtggagagaatgagagagcacgcctgacccactccttgaggctctgcagttgctggcgtccccaagtttttaggtgccaccgcatcccccttttccagacaccagcacctgcaccagaaactacgtgtggtacgcctgctccagctgcagcctggcaaggagccggcacctctgccagcacccagagctgcctgccccaccacagctggccggaccctgtgttagctctctcacacacccttcagtgctctgagcctggtttgccctcatcaggcgtgggatccgggttgggcgaactgagtgcagcctgccgggctgagtgggtggaacgagcacagtgggagtgagtgaaactcaagcaggggcgccacaggccacaatggttcccggctggcagagtgacacctgaaggatcccgtgacatttcgattatttctgctcatagcataaactcttatatgtaagtatctaccacatgccaaaatgaaagcaaaaaatatatataatagcctgctgtagatatatattatgttgttgtagcagctcatgttttctaccatccatacgtttaagataaatggcatgcaatatcaccaataataaggcaatagagaacaaagagtctgcaagaatttagaaaacacttgctttgatatacagcaagaactaaggggcaagaagaggtaatgggcaagctctgagtcactcttactggatggtctcagtacagcaacagtaactaggataagccaaggcgtcctctacacacatagtgaggccagcttgaaacaaggaagtacatagttgcagacttggaagctagccaccgcagctatttaaaaatcaatagagagattattttttaaaccctctttatccaaaaagagtgttctgtgaagagaaatagaaggcactagaagtgacgcactgaaagatctcagttcatggaatgatcacatttgtaaactaatagtttgtgcctctttttagagtcaaaagtcagtaagctcaagtcagtaagctctgggttggaattccagctcctgtttattagctgtgcaaccatggaccaatgtacttcactaaccctcagaatcttcatttataatttcaggattatgatattgtacttatagagctttgaagaggataaaatgaaataaaatgggaaaacactcagtgaaatgcctcatatgtaattaccatgtaacggtttttcctttcttcctaatttcatttaccaccttcacaatttgtgtcatattcacatgccatctacattatttacttaatattgttcctcatatagatttacatattttttctaaataaatttcgcctcatcttaacaacactacccactgagaggctgaatataaaatggacaacagtgagatcatgtataaccacagaactctgagccacaacctttgcaaccaacgcaggatggcaaaccacaagctctgcagccaagagcccagaacggtcaggacttgggcaatgacaaccaaggaccaaacagaaaaagctaagatgttccccagaccagtcacacaagatacccacacttccagctttcccatgccaacagccttccaaccacagcatacctaaagctgcctctttcttccattaaaaagcttctccactcccttgctgagcctaccaaagggaagagatggtggctgactggacgtttctcaatctttggaattactaaatacagcaaatgtgtttttaaataataccctcagactctaggtagtctagaaatttacaacactgcttcttagtgatgacggagttgttatataacacactggttcatttaaaagaacaggaaaagagtttgtgtactgataataaaaatttaactcatgttgagaaaaataagtaataaataccaatgaacaaacaaccagcactctcaaggactatatggtgacacatctattgttatgtgcatttgccaatcagtattgttatggttctacaaagaatccagtgcaccagactgcagctaattatgtatattcaagtgattagcaagcacttgttgcctctttcacaccaccctccaaacagcagcctttgagaggagaatagactgcaaatttattgagagaacactgttaatcctttggggagaatgtaaatgtaaacaggactactctacatcaaggtgctttgacaacaacaatcatctgcataaacacatgctcaacaacaaacaggtgttctatttcacaactagcacccatttgatgctttcaagtaagcattatgcacaaactgttagaagtactttgaaaccagctgcaattactataattagctgctttcctatactttgtttccttttacctgttcagtactgtgctatgccaattcatacactccaagtaaaatgaccagttcaggacttttactggtaaggtatgaaaagcacacaaactagactccatttaaactaagtcaactggaactttctccaaatatcaaaaatactaaaggcaaaattcaaatacttctattttaaaattacattaatgagacaaaagatagctctctttcaaagctgtttaaagttttgactcataagagacctcaattattgtagtattaactgactagaagaggaaaaggggaaatattctaaaagtctatcaattaaagaataaataaaaagtagtgctacatattcaaatggaatactatacagcagctaaaaggcataacctaccaatagctttagctacagctgtaactacattgcacacggacagagcacaaaaacaatattaagtgaaaaaaggaaaatttcagaatgccaataagtataagctaacaatcataaacatatgtagtgaccaaatcaaaatctatatacaagttatatctcagagaccttttgggttcagttacagacctctacaataaatatggcaataaaacaagttatatgaaattctggtttcccagctcatataaaagttatatttacactacactatagtctattaaatgtgcaatagcattatgtcttttaaaaagtacgtatcttaattaaaaacattattgctaaaaatgctaatcaagtgagcatatgctgttggaaaaaatgacacagatagacttgctcaacagagttgccacaaaccttcaatttgtacaaaatgcaatatgtgcaaagtgcaattaaacaaagcacaataaactgaggtacaactgtaaccattagcctaattctaaaaccaaaattttcaaatgtattaatataaatctcagaaaatccaaaagtcaaatatggcatgaactctcaacagaaaaaaattagctaattctcttaaatccaatccaatgataaacacactgtcaagtccatgagggctgtgactatttcagcactgtgtactgctgtatctcctgtacctcactggcacttccagtaagtaatatttcatcaataaagtatttatgaaggagtgaatcaatgtatgtatgaatgtgtaaatgagtgcacaaatcaaagttcacaaataaactgaaacactgaagtattgtttaaaaatatacagtgtgaactataaaaaggaaaaagaataccaggtcacattactccattacagtcatgcattgcttaatgatggggatacattctgagaaatgcatcattaggcaatttcctcactgagtgaacatcatagaaacacctagtttttaggctacaaatctgaacatgttactgtactgaatacgcagttctaacacaatggtatctgtgtatctagacaaatctaaacatagagaaggtacagtaaaaatacagtacacagggtaaaaaaaaaagtggcacacctctatagggcacttaccacgaatggggcttgtaggactagaagtgactctgggtgaatcactggtgagtgaatatgaaggtctagtatattactgtagactactgtggacttcataaacaccgtacacttaggctacaataacaaaatatttttctttcttcaataataaattcagcttactataacttttttacttcataaactgtttaattttgtagctttttgactcttgcagtaacacagcttaaagcacaaatacactgtacagctgtacaaaagtattttctttatatccttattccataagcttttttctacttaaattttttttaccttttttgttaaaaacttagatataaacatacatattagcctagacctacacggggtcaggatcatcaatatcattgtcctcctccacatcttgtcccagtggagggcttttgggggcaataatgtgcatggggctgccatctccaataacaacgccttcttctgtaacacctcctgaaggacctgcatgagactgttttacagttaacctttaaaaaagaaaataaagcagagagagtacactctgaaatgacaacagtataataaatacataaaccagtaacacggtcatttattatcattatcaagtactatgtactgtatataattgtatgtgctacacttttgtacaaaactggcaatgcaataggttggtttacaccaccatcaccataaaaacgtaatgcattgtgctatgatgttacatcactaggcaataagaattttttagttccattataatcttatgggatcgctgtcatatatgcagtccatcattgactgaaacatcattctgcaccacatgactatttttcaacatgtttctaaaaatatcatctaagtatgatatttgaaactttaactggctactcataccaaaagcaatttgtaacattactttatacccagaaaaatatttcgttgcgtttcctctcataacattttccaccatttttattagagactactgtaacatacctagcaacaaacgttagcatgagtagccagctcttactatcagtcatcaccagtcattctcatagttgatatgagttgtccaactatttccatctttttattagatagctgcaaaagtgggtgcatgctcaccacaatcacctgtgggaaacaaatgtaaacccaactgatgggtcaaactgtagaggagagaagccaatgacaggtatttgagacaatgccatggaagaataaatagaatgggagaatgaatttgaagttcaaagtatgtatttcaaatattattaaaaagtaaaattattcttccttgtgctagtgctaaacacaaaatacatcctaaataaatattaagtacagtggtaagtaatttagggggagatgcatttagctttggttatatttagcctaaaccatctgccacatactttttttaatctgtaaaaataagaaaatgcaagtgctagacagaaagcttgagatgggggtaaaaagtatatgctttgtagtcaaatacatggattcaaatcctggctctgccacttattatcagtgtaacctggataacaatccctctgaaactcccatttcactagaaaactggatgataataatttggtaacacctaccacagaaagttgttctaaagcttaggttattttatataaaccaattagcatagtgcctggcacataccatagtgagtaatcaatgttagaaattacaattaccaatcattgtcttagtgataaatcaacattcagattccaaaaacctggggtcaagaaaaacataaaaggccttaaatggctgtacttgatgcccactgttaatggaatttactagaaagaaaggaactaaagaaggctgaaggaatcatagtcctggaagaaaatgagaagcaagaattagaaaaaagaatggccctaccaataaaggtttaaaagtcagaaaaataacagctatagaggtattttgttcttaaagctatttcaaaggcaaaccaaaacaagaatgaagtgaatggtattatacagcaatcttaaagaaattaggagccttgcaagtactaagttcgaagataaagaaatggaagcctaacaaaatgagaaagtcaaggcatatgctgatttgaaacaaaacagacgtactaagactttgcttaagattcatctactttaaaacacctcaaagtccacgtaacttcatccagatgtatgccacccctatattgctattttctttccaccttcccaacagataacagccatgcaactggcatttcatagacacaagtatttgctgaataaatgaaccgtcacacacaaataacatatgtaaattatctgaacatagagcaatctttccagcatcatttctcactagtccctttctcacagaatccctcaaaccctactaatctactttcacttccagaaaggtgcaagagtcctttctgtcacacttttgctggtccctcttcccataacctgcttccattcacagtgtaccaggcaactcttactctaccttcggatctcagcttcaagctcaaaacttctagaaagcctttcttggctctatcatacacaaaatgtgagtttggacaagtcactttatttctctgtgcctcatactcatctgcaaaatgggggtgatagcgctttcctcataaggttgctatgagaattaaatgagattaattcaggtaaaacacctaaaatagtgcttggcgtgtagtaacagctcagtaaggcatgggtgtaattgttattccctgactcctaaatccaggttaggagccccttctgttattccttcttcttcttcttactagtattccctttccctaccacagcatttatcaaagtgtgggttctacaatgttttgctaagaaagatgaaaagtagaaagaaaagaactaatgaagaagtagaaagcaaaagaaaaagtgagcactcaatacagggatgaacaaacaaaagaaagtgaaaaggagaaaagggacagggtagacttccttaagatattagtaaaataaagcaattcttgttttaaggatttcagtagctttcctcttgagccaaaaattctacaataaataggacaactatgagaatccacagggagaagtcattggatggcaatgattagaacaatattttgttataaatcagatgaaataaaatcaggagcaaaaaggatttcccatctaatctagaataaaaatcacatataaaattgatctagactaaagtaggatgcacttgtaaattatgaaaagattccaaaacattgaagtactgtggtctcttcctacaaattaactgttcattttaaagtaatataggatggcattatgactgaagataactaatatactcaaattgcaccgactacatccctggcccagagaagttaaaacagaagaaagcaacaatgactagactcttcaccaaaaaagaaatgtttgtttttgcaggttagctccaccatttttttcacatttgcatcctaatagttctacttggtctctccattatgcaacagttctttacaatacagccagctaccctgacaactgggttcctttgccagggtggctttgtctaaatcctaaagctgtgcttggctttgcactgagcccagtggctgcctgtgatctgaatgccaatgaagactacagaccctgttgtctaacaagccagagactaaaaggtctctttggggtcaacaaactgtctcgactactttcataagcttaagagactggaaaatgaagctagaaatgcatcttatttcttaggaggacaatgggggaaagtattaaacgtttaacattcatcagatactgttagggcttcaactttagggaggtgtctagtaaaccttcacatgtaaataaagtacttgttcttttaagaaggaataagcttcatcttaaagaaaatgtaaataaattttatattatcaaatttgaaaatgtttagagaatttatgtgctcaaaagtatacataaatgtctccagtcccacttcccacttagtactcgttgaggatgaacagataatgacacggaaataaagatggtaaaccattacacactgtaaaatttagtgttcagttacaatctaagaaatgcaaaactatgtaactctaaagaagcaattaggtagtatatactaaaaagcaaacattaaaaatgctaaaatccaatggtagaagaatattgttttaactacattattttagtttgtcaataaaaaataacatgcattgtttttgcttgtttacatgtctgaatctgccattccgctaccatacattttcttgtatttttgtgcttggaggctcccttttccttctttataacgaattcaccatctctcatttaatcaaatggcaaatcctatgttttatttcctagatcactctcaaaccttatgcttttgccacaaccctagcacagatcatggtgatctctcatctagattcctatgagagcctctgaactggaatctggccggagtagtccaataagacacataatgtgacacatacatgtaattttaaattttctaaaagccatacataaaagagcaaaaagaaagagtaaaatttaactgaataatatatttaaccaagtatatccaaaatatgatcatttcaacatataaccatagaaaaaattgagatattttacattcttgttttttatatcttgaactcaaaatccagtgtgaattttacacctataatataggtcaattcgcactctaaattttcaataacttatgtgaaatgtagtccaatcaaaatactaaagttaaaggaaaacatattgtttaaaattttaagttaaatttttaaatcaaaattaacaaaaatgtaaaactcactcctcatcacactagttacctttcaagtgctcaacagccactttggcccatggctactttgttgaacagtacaaatgtaggtcttcaatttttgcctcttctaacctagactgaacatattcaaaaacagagatcattcacatcatcttatggctttaaagcccctcaaccacgtcctgctgatctgacaaaacccaagtgcttacacaggttttgcaacctaggctccctcctccttttccagcctcagctatctatctccattttccccttacactctgttccccagataaacaatgctttccccaaatcccggaacatgctgaactttgtcccctttggcatgtgctgctagtccctcaggtttcaaattagaaatcactttttctttttagagccctttctgttacacagcacaagctcttgtgagggtaagaactggatcactattgctcattattgtatccccagcatttatcaaaatgcctcatattttgtaggcactcaaaaaatatgaatcaatccacagagtaatcttagctgcccaaaataggccaaaggcatgtcctcatgtcaacacatgtggccggaagagaagggtcttcctgggagctcattacatggttttactatcactaaccaaaaaatgagagaaactacgccaaaattagcaccaaaacacttagactctcaagtttggaaaatgcagtacaaagtaatactttgtgttttataggttcttttgagtccactggaaaggcagtatacctgagtaacagagtaaattctagtgtcaagggacttgtgagaaaagcgtttgccccccttcttacaaggagagctcattagtattatttcaggtttctttctctccctttactccctctaattctggtaagatggagtattttaatctggtgaaaaactggtgaggaaaaatccttggtatgcaggattctgctgggccccttttcttcctgttgaaactagtaggctgcagaaaatgcaaatgtgtctttttcctctatgcaagagatcagcaaactacaaaaggctgatgcctatttttctaaataaagttttattggaacactcattagcttacctgttgtctatggctgttttcttgcatcacaatcacagagtagctacaattgcaacaaaaaccataaagatccctgctctatggcactgtcttatttatattacctgaagagtgcttgaaaaagttggcctggttctgcaattcaatcagcaggtcatttggctctcaaactcagacctccacttggacttttatcattagtaggtacgttctggcctctatctttactcttcattttgtatctggtattgtacaaaggccaggtaggaaagaatgacttatgccatgacctctagaaaccccaatccttcatctacataaaatttccaggcatgtttattaagttctagggtataaaatttcaggggaggggtctcatcaaatatttgttcaagctatgaaatacctggaaatctgatttttgaagaagtgttagccctacatctgggaaatttatatcattaatgttaacttcatcacatatataactgtatgttccatatatcgtcaataaagaacactaacagtataaactccagcctagttcttcaaagacttttagtattttcatgataggacctttgtttcatgcaagcacgtacctgtattctgggcagaaattttgttagtctttgttgatttttgtttccttgtttctctgtttctctctcaaaacaaatccacattacccaaaaagtgacactgaatcacccatttccagtaacactaataaataattattccaatactttattaagaagcattcacctttttctcatgccaatgtttttaaaaatagaacttttttacagtgaccattctatcatacatatttgtaaaaatatacatgtaagaatattaatcttggcaataactataaggagttaaagagagggaatcaagatttcccttgtaagtttataagacatagtccaacaataatcttatataagctattttaattaggtcaatgagagtgttgcatattttcataacatgctttttattcatttcaatttcttaaccagctttgttccatttaagatcatttccttgcgctaaacatctcacatttccaaatttcctataataaaaagttgcttaagtaatttaatagaacaagactagcagacatgataaaacataaaatacttcctaccttggtacaaactcaggcttacttttggttgctgggaattctaaaatgaaaccaagaaacagcttttccaaaaaattacttttgtgcaaagaattagaaattaaacatgaaaaggactttatttttctcaatatttttattccaattagactatgagtaatctgtgtattaacagtattcaaaaaaatacctgtaaactacagtatttttccataatcctcagtttgtgataggccattctgaacccatgagtttctcatccacagattcaaacaactacagatagaaaattaaaaaaaaaaaaaaaaaacagtaaaaaataacaatagaacaatatatgcaaatgttacaccattgtatataagggacttgagcatccttggaatttggtatccacaagggacctagaaccaatcccctgtggataccaaggggccactatgtctgtgtcatatgcctctctgatagttaccacctttctaaattgaaaatttttttaaaaaagcaaaactagttaaaatcattttaatgttataaaaagaatcggattttatgtaaataataaatatactcagaggtcaggcatggtggttcacacctgtaatcccagcactttgggaagctgaggcaggcgatcacctaaggtcaggagttcaagaccagcctggccaatatggcgaaaccccgtcgctactaaaaatacaaaaattagccgggcatggtgctgggtgtctgtaattccagctacttgggaggctgaggcaggataatcacttgaacccaggaggtggaggttgcagtgagtcgagacggcaccactgcactccagcctgggcgacagagcgagactccatctcaataaataaataaaactctgataatcagaaaccttaaacatttctttttgtgaaagttttcttctcatttggtagaatgataaaacaaacgtttgtcctttttcattttcccatcataaaccgatttctcctcataagaatattctccaaaccctagtcttttttaaaagcagcactctcctcacaaaaaattatgggcataaaaatacttcaggggctccagggtatctttttttttttttaatgtgtagaccatttacgaaaatgaaactctgttaggttacttaacattgactgcaacaacaaacactagcttattacataaactttagaacatgtacatgttcaccactgcaacagaagaggtcagaaggaggtagctcttaactgactcaggccaaagtgacacatactattttcactcccaattcactggccagaaattagtcacatagatccaaaggaagtgcacggaaggctcgaaaatgtaggagcacatagaaaagttggtctccatctcaaaaacagctctaaaatactgctcaagaatcttccaaactctgtgttcaatgataaggttgtaattggccggtaaacctaaaattaggcagatcaacttttaattataccctctacaatgcctaataattttaccctggaagaaaaactttgtatataagggacttgaccatcctggcaaagaaatttcctggagaagacttccctggaaggaaaaaccactgtttgtttaaaacacttcattttttctagtcttgttttcaaaaatactatgaataaatagtcttaataacactcagaaggtagcatttgaaatcaattccatggtttgaaatacatagttttattaaggaaaaaaatattttcaaagaatttcacaacttatcaaatacagagatagactgaatgattatgccaaatgttttagaaaataactaatttacaacagcccttcttaacataggaaagtttaatattttaaaatgcaagtgtcataaaatttttttagtactccaaatgaatagtaaatatatgaaaaagagttctacttcattagttatcaggggaatacaaattaaaaccacattactggccaaggttgatgctacacctgtcatgcctgtaatcccagcactttggaaggattgcttacacccaggagtttaagaccagcctcagcaaccataggaagaggcccatctctaccaacaatatcaccaagtgttggtgaagatatagaacaaatgaaacttacaaactgctgctggaatataaagaataaacacttaaggaaagcatctagcagcatctacaaaagttgaacatatgcacgttctatgatccagcagccccacttctaggtacatagccaacagaaatgtgtatgtatgcacacccaaagacatacagccaaaatgtaaaaacaaaacaaatccaaaaatagaacagataaactagggtctagtcatgcagtggaaatataatacagcaatgggcctgaatgaactgttagtacaaacaacaacatcaataaatctcacaaataaaattttgaaaaagccgccatatgatttcatactcaaaagcaggcaaaactaatatatgctgtagaagtcatcctgtttgcttggtgggacatagtgactgtaagggtagaggaagggaaggcttataaggtagtggtaatattgttttttaaatataggtgttacatggtgtgcttacttcatgaatatttacagagccgtattcttatgattctttcacttttatgtatctcatactttaagaaaaagtttaccttaaaaaattattggccgggcgcggtggctcacgcctgtaatcccagcactttgggaggccgaggcgggtggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcgcgcccctgcactccagcctgggtgacagagcgagactccgtctcaaaaaaaaaaaaaaaaaaaaaattattatacataacagaaatagactctcttgattgatcacattttacaccaccaactattagttccagtattctttactatgttcagtggtaatttctgaaatggctattctcatcaccatgaggggatctcatttgtgatcactgtattcatgagtccttggctcattaaaaaaaaaaaattgttttaatttctcaaaaagatgttcttttacaagtaatgggggagattttaaattttcctgttatgatcttactgaagctctcagttctaaaataaaagtaggctgggggcagtggctcaggcctgtaatcctagcaggatttttttggggtggggaggctgaggcaagaggatcacttgagcccaggagttcaagaccagcctgggcaatatggtaagcccgtcctctacggaaaatttaaaaattagcccggcgtggtggtgtgcacctgtacagtcccagctactcaagaggctgaggtggaaggattacttgagcccaggaggttgaggttgcagtgagctatgatcatgccactgcactccagcctgggcaacagagggagatcctgtctcaaaaataaaataagagtattgggcatatcaatttttaagaaaacgagatatgatgtcaaaattatttattttaaaatgatcagagcatactaaaaacatgtatggatttagagatgattttggtcaatcctccttattttacaaaaacaggaaaagtgatttgcccagggtcacaaaagtatgtggtaatagatgatattagtcagtactcagctctctggaatgagaatttgtccctattccctttaaaccaagcttgtccaacctgtgaccctcaggccacatgcagcccagaacagctttgaatgcgcctcaacacaattcacgagcttaaaacattataggatttattttgatttttttttagctcatcgtgtggcccaagacaattcctcttccaatgtgtcccagggaagtcaaaagactggacacccctgctaaaccattctgctgctcattttatcactggcactaggaatggaggttttattatgcaaaggaatttccgatacatgcctttgaagttggatttaattaattcaagacacataattatataaagtgagcatctgcagtacccgtagtattcatcctgaaaatagtttccaaaactcaatgcattcagaacttcaaaaaaattaatgtagcaaaatctgcattaactctaaaattcagctttaatgcaggtatcaaaaacttcaaaaaaacaaattccctatgtggaatcaaaaagatctttcaggttcattcgatgattttttactttgctttgtttctgtttccatttagccctattttaatgcttattttactaaactcaaacatagggagtactttattttctaacatgtttgtctccgtatgtttttttcaataatttaacgtccatttctaacttgcctatcagtcccaggtctttttagatctttctcaattatggttgttattttcataatatctaaatcatatcatatgtaattgttctattaaaatgtattctgtctttacatttcaatgagctaaacatgctttatcttgagtgataaatgttttttcccctaaataataccaacataagcctatacttgatacagccagttaaagttagaacaaaaactttagagaaaatttctggtcaattagtgtgtcactgagttaatgaatcatttaattaccacttgcttgggttatttgtcccctcactttatcaataaagaacacagtatgacataagaaacttccaagtttgaactaagtcacagccaggacctctgatttctaatgtacctgaaactaacatactctacagaaaagatgaggggtctcataacctctgcatattcaatgctttcatattcaattgtttgtttttaaagaaattagtttattagagacagagagagaacgaatctttcccttgataatctccactaaactttataaatatgcttagaatggaaatgaatgagaagaaacagaggatgaaggagacatcagaaattttcagccctgtgttttacctctggagaattcttattgtcatgaagaacatgaacatggggggtggggggcagtacaggaaaggaacaactgcaagctgccatgctgagtttaacaacaatcatcaaaaggggctttgggagctcaccagctgcaaagtttttgtattaggctgtgattccattgggaggatgggagcccctaaataatgatgtcaaaggggtttttacatgcccaggaagctatttcaagcaaacaaaaatctacatttattcctaatggaggttaaggcctttggggattagagatagagagtgtagatggctattatctaaataaacttactgttcctagcacaacaaaggaatatattcctaaaaagaaatataggatattattttcaccgtaaaactgcaaagaaatgaacactttttccaagaacaaacaaaaatgtcagaagtttcattttgaaagttatacggcaaagtgaatttgagaattaaaagggaattagaggataatttcaagaggaatttcattaacggagatttctgcatcatattttcatgctttttttattatagagtgtaattcttaatgactgcttcaacaaaatttggggaaagtaaaattacattgccattgctgctaagttgtaactgaccttctctcttgtacttgtattctacccagtacagcccagtaaatgcagcatgttcacgttcacttgtccaaagcaaaatgacttctttcccaagacacaatgaagagattaaagggagatatcttcaatgaacagaccaaaatgtcacctaacaacatgcttagtaaataggtacctttgcaaatgaaactcttagtatcacattgggaattaccatagaaaaccacattaaacttattgtaaactgactttatccataaacacaaaaaaaatcaaaagggataaatgtaagacagttcacttaagacatagtataggtttcttgcaaacatggctaaaaattacttaacaccataatgaataacaaggatcggtaagagtcagtaatgaaacgatgtctgaagcaagcactgaaatatacctaggcatagcacatgcaaaaaatgtgatgctatgctttttcaaccataatgacctgtaaattgttttatactaaggcccaacggttctagcaatgctgtataatctcacatctttcccctgtcaaatgaagaaaaaattaaaagatacacaaacataaatatatcttttaaaacatatagcatgcctgggtattgtttatatgattcagtggaaatcaacatggtttgctggtgtgtctggttttttgtgttttaatatttatattgcatagctatccaaaattgttcagagttttgaaagaaccaagttgtaaaaaattgtggataggcaggaattctgacaagctttctaaacatgaccctttatttcaacatgaagataaagaggcaaagctatactgattgaacagaaaacaagaatgggacttaaaaaaaaaaacaagagttggatagacagtgttcttccttctagttgataggaaggccacacagtgtaaaactatactcacaactttggtgttcacatgcacaatcttcaccacttagaaagaagcagctttattagtgcttataaaaattcattagtccctataaaaccagaaccaattcagcagataagtaaataaaacaatataaagaaaataaattcacaaactttaatgtagaatttcagaaaatgttaaagttcactgagaaatactatttagtgtgattaagataataaaaataaatcaataatgcaaacacagtattaataacttgaagttttcaaatttgagaggttttgttctcatgagaatattctctcaaaagtagtttagttatatgaataagatttctggataataattgatctgcataggctattaaaaattgcctgtttatacaggtctgactttcaaagccccaatcttgagtacgtgtcaaggttagccttaccatacgaatcagagtgacatctagtggcaactccattgaagtactacttggtacttcatctgttgtaaatacaaatgaacagtacctagcatatggcaggccctcacacactgttgcatgaatactttaatattttaagctaatattataatttcctcagttctactgaacttcctccttccttttccttaccacttctagtccttcattctctccctattttctcagttgaaaagttcccttctacttgtctcattctatggaatccctgatcattctatatttttctaatccactttttctttcattatacacatcttatcagtctccatcctaggtatatgatataatccattttatgtggaactcttctgagtactgctatactaaatcacgaaactaaaccaaataaatctatcataattcatgcaaacctgggaaattatttcattcatctctagttgacttgatcatgattgttttctaaaggaatcatgccacatcttctttatccctcttcaaacccctctcccccaaccccatctttctcattttataatatccctacttcctagaaagcagggaaaccattaaacgtgaataacttcaacttcccagctctctacttcaaacattcagaataccccctttacttataacaaaggaagtcatatacattctagttttcaagaactaacccctctttcttgtgtcccatctttactgtcatctaagatttgattatgtcaaatgatgaatctctctcttggatctttctgaatttccctctgtattttgactccattccttcaacctatgaatatgctcaaaacatcccatccaaaaatcatctttctttggcttgctgtaatctattttctttccttttatcaaaaaataactcagaagaaaaatctatgattactgtctccatttcttcagtatccattcactcttcaactcctgccaatttgctatttaccatcactactactgatctccacaaagtcaccaatgaggttatcagtggcctctttacaggccttgttgtccttgaatcctgaaataatgctgtaataattgctcttgcttggcatctaaagtgaagtgatctttttattctcttccaatctccctcataactccttctctgctttcttctccttctcatataggctaaatgcaatatggcctcatatatacttgagcaaataaagaggcgaagtcatgcttttataaagaaagtgcttcagtttctaaatagaaattgatttgcctatgaatttagctcaaaattatgtactgcttaataccctcctttccttcaaagtaatgctttaaccctacttggttaaatttgccccaattatttcaaatcataattcactgtccctaataaaccaaattttatcttgcattaacatacattttgtatcatctttagatgtgtcctaaggttttaaaaattctctattatgttaacttgcaactactgtatgcctccttctcccaccttctctcccctctcacatgcatgcacgtatacacacacacacacacacacacacacgcacgcacgcacacacggtattttacaaggacagcaagctcaatgcctttgtcctccacttctgggcatttcttcaaaatgttttaaatctgaatatactactctttaccggtaagttattagtaaatgcttgttgattaaggctaatcttttttttttttttttgagacagagtctccctttgtcgcccaggctggagtgcagtggcacaatctcagttcactgcaaactctgcctcctgggttcaagtgattctcctgcttcagcttctcgagtagctgggactacaggtgcctgccatcacacctggctaattttggtatttttagtagagacggagtttcactgtgttggccaggctgacctcaaactcctgacctccggtgatctgcccgcctcggcctcccaaagtgctgggattacaggtatgagccaccacacctagccaattaaggccaatacttcaataactgttcattaaaaagaaataatgttttttaaaagaaaaaaaactgacttttgttttagctgttggtactgatactatcagtctataaacactacaaacacacagaaagtgagataatgctttggaaaaagattaattttctaattctgagctaactggcccaattttacttgtgaaaactgctctataatttgtcacaactctaatttacaccaaactcaacataattttcttaaatgcttctcaaaaaaaaaaagactctgaaagagaaggacttctggaaaattagcagcaaagaatcatgaagaacaatatttgaagcctctatacaacttttataaaacatttgccacaaggcaagttttggtgtgtgcaaaaatccatttgtagaccagctgtgacagactctttaaagcatatccaaggcaatgataaatgaagcagacattcatgccaaacgcttggatttagatttacgtatcaagaaagctttaataagtaatcctacaaggaatacagttgtatctacattttgtgtaagtaatagttgctcatttctttttaggggaggggggaatgctatattcatcttttaaaataaattcttcatttttgttttgttattttttctccttagtctagtgaagagagagtcagacaggatattctgctatgaggccctggcaaatctagtccattgttgtggggagaggggcactttgatctggaagatacacagggactcagatttagaaatgcagcctggaaaaagcattctagtgctgaatggacctttgtctacaggaacagttcctgagacatgcatggaagagctgaaacaggacccagcccacaggggaagagagcttgcagggaaggtggggagggggacagaaaagtaggctgtagctattccaggtgagttcttcggtatcaagagagtttagggaggttggattatcctccaggaacttcagcactggagcctacaactatctaggaccattttaattagctaatctgctattcacatttataccccactcaaccaaaactctactagcttcagggaaaggtggaggacactacagaattggtactctgattggctagccaatcacagccagctgttgagctgggttaatgctgtatacagggtccaaaacagtgcaggttgggcgacctctgttttattatttaagagataactgaaagtttctttgcttttgatacaaaaccaaaaatcattaaatgagagaacatttttaactaagaaaaaaatttttaaactgaaaagtacaaaaaatacacttatccaaaatcaggcatatatgcatctgaaaggtatatctactaaagtgatatgacataacaattttaaatagtcctgaaatgttgaattaattatagtaaccatgagcactgctttccgaacagctttgattctgaaatgaacattctttgtatttgatgacactaattcagcctttttgtggtcgatgctataaatgttacggaaattatgtactgcccatgttcattacctaaatttcacataataataggtttgttaaattaatttttccctaaaatagataaaacaattactccttattaagcattaatcacttgccaaatttaattttctaaaacaacctcatttcaattacacacaagtcttagatttggtattttcaacttttcattttattttttcaaattcaaatagactttagattttaaaataacagaaacactttgcaggtagtcccttggtttataagtggtgtgaaattcactgtagcttctgggaactctgaatgctttgctccagagaacaattatataaatagttaactctgaggatgctgtcataaaggtctattaacagtactagttagtttaacagtactagttagtaccattaaatcagctctaattctaggctcttgggatgaaagtgtggggggaaaggaagttaaagttttcatcccttttcccaggcacagacttcgtcccaagcagacatctgaagtgggcaaatggaattttggcatagtttctaccccctttcccaatacatagtcttttcctacatcctcttgttgtttctaccagtcacaaggtcttcatgcttcctccatcatgttatgccattttgatttgccttaagttctccaaatgtcccatatttcaaaatttaagccctatatcaccatccgatttcacaggcaacacaaagaatgcgaactgcttctaaggagtaagtgaaagaacatgcctaaacctttttaaaagtaattaagttccatgactatgaacttaaataaatgtataatctatggggtcttaagcagtgtaaaaaattaaagtaaaagcaacattttaaaaagaaagctagggaatataaagcaaggtatttggatgcagaaagttcctacgtaagcagattagcactaacctaaaagcgtacgatttttcactttcctacagtttcttcccctttcccctaaacatagtttctcaaaatctagtatcttcaaaattgacctaaaaattgaaagagaaacaagccaacaatgtccccttagatatatatacacacaaatgaccctaggaaatctgttttcaataaaaaacttctagaatttggtttaagaaagaaatgtcctttcagtatgtacatctgatagttgtataatactgttcttttgtacctcaatgctgatcaaggttggtagagaaatgaatgtttcttctaggagttgtaaccatttcatcataatatattcctcatcaagactctccagttgttctctattgtctgctatgtcaaacacaactcttgaacaggttaggggcttaggtagtagagtgtaaaataactgaataggaacattgagatattttatggcaaacctccagaactaaattgaagggctagaatcccatcttttcccatgaagccttctataaagcaaagatggagaagtaacaatgaaccctctcttctaataatgtgacataggttagcgcttaatgtatatactgtcttgaattattctctgtgtgtttcatatactggtcttattctctgggtagataatgaaagcctggaagtagattatgtacaatttgcctcatctctatttattttcccagtttccttattatagagcacgctttcactctcaacagggtactggtttggaagatacacagccagcttatccttaaagtaaaagaccatgtcttaagtttcttttctgacatcaaatacctactatacactcaagggaaactttgatttgtttgactgaactccaaatttattatggagtcattattttcttggttacagtctcatggccctctgtactttccataattagcatttaccacagttgataattacactgaatgattagctgtagaatgcctgtatctgcatttgattttactgtgagcagtggtactcaaaaccaggagtagtgatgtgctccccaccctcactggacatttggcaacacatagagacattcttggttactgccaatgtgctgagggatggagagataggaggtgctgttaccaagtgcagggtccccacccctgggccgcggatggtggctgttaggaaccaggccacgcagcaagaggtgagcagcaggtgagcgagcattaccacctgagctccacctcctatcagatcagctgtggcaacagattctcacaggagtgcgaaccctattgtgaactgtgcatgcgagggatctaggttgcatggtcctttgagaatctaactaatacctgatggtctgaagtgcaacagtttcatcccaaaaccgtcccccctcccacacaccacccaggttcacagaaaaactgtgttccatgaaagcagcccccggtgccaagaaggctggagacagctgacctcacgggcagaagccagggatgctgctaatcatcttatagcgcacaggacagcctgctatgacgaggaagaatgatcgggttcaaaaatgctgaagtgaggaaaccattccatgaagtcaagaaccctattttgacttacagtcttccagcagagcagcttgatatgtaggaaatcatcaataaatatttgccaaattaataaatgtatcactcaagtcctttttaattattattggtttttttggagacagagtctcgctgtgtcccccaggctggagtgcagtggcacaatcttggctcactgccacctccgcctcctgggttcaagcaattctcatgcctcagcctccagagcagtggggattacaggcgggcgacaccacgcctggttaatttttttttttttttttttagtagagacagggtttagccatgttgcccagggtggtctcgaactcctgagcccaagtgatctgcccgcctcggccaccaaagtgctaggattacaggcataagtcgccgtgcccggtctcctttttaattcttatactggctccttcttactccttgcctgtcttgtcatatgtgcaaacccacctgaagcactggaaattgagggtttaaagtgtaagcatatctttgaaattctccagttactactagtatactgatagattcactgataagaaagcaaaactattggatacatttagagcttcatgttaatcatgttctctatgttacagaattataaattataattacaaagaaaactctcaagattccccaaagtgttttcttataatcttatcataacaagccttaagttagtcattagataagtttagaaaatagcaaatcatatttgtaaagaccagaataaaactctaagactcatccacatcatccaaaatgaacagtaaaagaacccttttatcataaagcaattccacctaaagatcaaagcataagctttggtgggatatgggaatccccaaagtatgcattaaaatgtgaaggcctttcttttcttaagtatttaggcatggccaaaggaagtaagaatctgctggtactgtagggggaagctaggagaaaagggtcaagcccaatcaaggaagtgaccacaagaagtagtggccagcatgattgagagattggttatatacagaagatgaaccatataagtcatatattgtagataactgaacccctgtttctcactggaagttacaaatataaaaaggatgaagctagaatggactctttggtgtgagatagaaattgaaatgtcaatacaaattcagtttttaatatacagatgcagaaatcgtaagaataagtgagtatgtcatacaattatttcctaattttatttttaatgaaagagcttgacaacagtgacactcaatacagggaacacaattgatacccagatttagggttctaaatatcattctccacacaaaaaagaatcaagagtctctggaaaactgctgattccagggctgaagcagggatatcacaagcggagctgggaccatcttactgtgccagagagtaagaaggtgctcagagaatgatggggacatgttaaagggcacagaagtttgaagggaatcccgctggccacatctgagacaatctggatatcaaaatacataatacgaaaacactatgactcatttgttgaataaaacaagaatccatgagcccatattgataaaaataaataatgaatctatgaatggagagtttccttataagagaatcccaactaatgaatgttgaagaaacaacaaattagaaagtcaccacttgacattcatcttagtcacaactaagttaggcaagaaacatcaataaatgctaaaactaatgagtcaaagagaaacataatatttacatggtctcaaattacctccttagaaaataataacaaaggacaaaagagtacctctacagtggagaaaactagtagtcactaccttcaggtgatcaaagttaacatcagtaataatggaataaaccaaaattgagtatcaattcagaatacaataagaacaaaacatcacttttgtgacattgctgccaaaaatgtataacctacatctaatcaggaagaaacattagacaaactctaattatgggatgctctacaaaataactggcatgtaatctttaaaagcataaaagccataaaaggaaagactatgaagccattccacatgaagagagtaaagagccctgacaatcaaatgcacagatcctgggttagaattttgcaatgaaagacattatcgaaagaattggcaaaatctgaatggggtctgatgatcagatggtagtgattgatatatcactattaatatcttgctttaatagttatactctttttacataagagcatgtcaatgctacaaaaatgcaccaaagtaatcaacagtaaaggagcatctcactctcaaatggttcattagaaaaagcattatgtgctcagtgcactggctcatgcctgtaaacccagcactttgggaggctgaggcgggtggatcacctgaggtcaggacttcaagaccagcctggccaacatggtgaaaccccatctctactaaaaatacaaaaattagctgggcgtggtatcaggtgcctgtaatccctgctactcaggaggctgagacaggagaatcgcttgaacccgggaggcggaggctgcagtgagccaagatcgtgccactgcactccagcccaggcagcaaagagcgaaactccatctcagaaaaaaagataaagaagaaaaagcattattcttacaacttttctttaagtttgaaattatttcaaaataaaaataaatgcaatgtcaaagttcttacacttgcagtctctacttactttttgatacagatttatctaattaatacttttttttttttcatatggaatcttgctctttcacccaggctgaagtatagtggcgcaatctcggctcactgcaacctccgcctctcaggttcaagcgattctggtgcttcagcctcccgagtagctgggactacaggtacacgccaccacatccagctaatttttttgtattttcagtagagacggagtttcgccatgttggccagactgttttctaactcctgacctcaggtgatccacccgcctcggcctcccaaagtgctgggatcacgggcatgagccaccacacccagctatctaattaacacttaaagctcttaaataggttatggtaataaatttcatgcatttgttattcacttgacaaatattaagtgccagactctctgacaggcactgggaggatggtagacaaaaatcactgctttcacggagtttatatttccatgggggagaaaaaaggttatatagtacgaaaaatgctaggagaaaaatatagcaaaggagggaatataatactttggggaagactaaagtaaccaagggaagtctcattgagacggcaacttttaaggaaaattaaaacgatgtgaggaagctcgatatagatacctgtgggaaagagttttcttgacatagggaatagcaaggctttaagatggaaaatgcctgacatgttccaggaagacaaaaaagctgcaataagagcatgaagcaggaagtagcagaaactgagatcagagaggtaatgaggagccagatcatctagagcagcagtccccaacctttctggcaccagggaccagtttcatggaagacaatttttccatagaccttggaagaggtagggggagaaggtgtcgggctgaaactgttccactcagatcatcaggcattagatttcattagattcattagttagagttagtaaggagcgtgcaacctagatccctcgcatgcagagttcacaatagggttcgcactcctatgagaatctaacctcgcatctgatctgacaggaggcggagcttaggtggtaatgctcgctcacctcttgctgtgtgtcccaggtcctaacaggtcagggaccagtacttgtccacaggctgggggttggggacacctcatctagagtcctatagattcctgaaaggactttcggcttttactgatatgggacgctacaggaggtttctgagcagaagagccaaatcattctgacttaagttaagtaggatcagtggggctgctccctgaaaaacagaataaagggaggtggctcatgcctgtaatcccagcactttgggaggccaaggcaggaggatcacttgggtccaggagttcaagaccagcctgggcaaaatgccaaaacctcgtctctataaaaaactacaaaaattagctgggcgtggtggtgtgcaccagtagtcccagatactcaggaaactgaggtgggaggagagcttgagcccaggaggtcgaggctgcagtgagctatgatcggaccactgcactgcactccagcctgagcaacagagtaaaaccctgtctcaccaaaaaataaaattaaattaaattaaattaaattaaaaataaaataaaataatacaaggacaaatttgatgagagaatgtccatcaaatttaactttttcatgacagccagtcctatatcataaagtacaataaaaacttaggtgaaagctaaattactaaatcatattttatgctataccttcccaaaataacatgatgggtaatgaataatattatgaattaaaaagaaaaaaaaaataaaaattcaaggtcttgttccaacatccagatttctttttaaaatgaacttatttcttacattattaaagcaatctgaaggtcacatcttagtgtaagtttaagaaatgtacttaaatgagaacagttatttaatcttataacaactgtagtaaatgcttcacaaacctaggaaagaagaaggaaaaagaggagatggtaatacgaaaatcacaaggcaggagaaattaaaattaagaaggataaaaggaaggttctgcttctgtaaatatcagattgaataattcagatgaatactccactgagaacaatttaaaatgtaagacaaaattaggactctgataagtcaattgccacattaagctgaaatcacaaatggctgatcgttaatgtcaatggggaaccaaaaaataaactaaatcttgcacagatctgcaccctagattcatgtcacctgagtggaccaggaaactttaggctttaaacttgggttaggctactcctagattgctatccaaggcatccagcagatattaaatgaagataactttactcaaggcttcattttgtctttttagagacagggtctcactctgtcgcccagacaggagtacggtggtgtggcctttgcccactgcagcctcaacctcctgggctcaagcatcctcctatctcagcctctcaaatagctgggactacaggcatgtacctctatatctggcttttttttttttttttttttttgtcatggagacaggatattgctatgttgcccaggctagtcttgaactcctagtctcaagtgatcctccagcttcagcctcccaaagtgctgggattaccatgggagccaccatgcccaacccaaggcttcatatttctacaaataattttcaaatactatgcccagctaacatatttaatcttcattattcatggattctgtatttgcaaattcacctactcacctaaaattatttgtgataaaaaatctgggtgctttaggggtcatttgcaggcatagagcagcaaaaaaatttgaataaactgatgcccatgttctcacatgaggctgaacaaggtgtcactcagccttcttccttcagctctcctattacaaacaatgtccttttcacagtatttagtgccatgtttttcacatttttgtgcttcctgttggtgatttcagtttaatggccctcatgtatagtgttgaagtctcacctagtgtttctcagcaaaagaaggctatgatatgccttatggagaataaatgtttgtttaaataagcttcattcaggcatgagttatagtgttcatggccatgagttcaatgttaattaataaataatattaaataagatgtcctcaaacagaaacacacataaaaccaggttatgtaattgatcagctgatgaagacgtgaccagagacttgcaagaacccagccctgtatttcacctagagcaatgggtcagtatctgtggcccctttatgtaacataactaacatgaataataaccagcacagccagtatttataaccagcatctaataagccaagacaccagagcagggacttcaaatactgaaagtatcagacacagagtgtaaatgaaacaactacatttactctatgtacaagaaaacagaagccaaacttgaaattttcctcagtgaaatataaaactatacaagagacatgtctaatttggaagagaaacaaattttgagaactgaaaaatacgatgtccaaaaataaagactcaatggacaagctaaatatcataatttagacagaggaatgcttatcttcagtgagtaaaagaaaataaaccctgacctagaactgtcttactcagtaaaaacatcctttaaaaatatggaaaaaatgaatgcattttcgcacaaataaaaactaaaagaccatcaatggataaatggataaacaatatgtggcatatacatacaatggaacattactcagtcttaaaaaaagaaattttgacacatggtacaaaatgggtgaaccctaaagacattaagctaaatgaaataggccagtcacaaagggaaaaatattgtatgatcccactcacatgagttactttacccttaaccatttaaacacattaaatgacaactacaagcaaagcccatagcaccacgttggatatttaataagaagtaactgttagctgggaagagatactattaacttaatgatgttaaattttttaaggaaagatgaatgtactttaaaaaatatgtacacattttaagaaatataataagtattttcttactgaagcaaaaaggcacagaattttgattcctttatcctggaatctctcttgtctcaacgttgcactgtcactaatccaaactgagtacctcataagaaattgggatgctaggacaatttctaaacgtcaaaataacacattttggtcaggatacctggcaactgtaaatgaataaaaacatctacagttacccccaaatttctgaagaatacgtttaatatcttcttaggaattctgagtgtctaagaatttctggcatgtatttagtgactaaatcatgtgaaatggatacttaaattatgtttattaaagttatctttcattcctagaggggaaaaataatcatttattctgtttagattgctgatcatctgttcctaaatttatgtcaacagaaaatactaaaaatcatagacaataaatttgctatgtaatatgtttattaaataccccctttgaaactcctttgtaataatttgatcaagctaacacacatttttcagaagcaaggtatttcaggaagaagagataatgtcaaaattatcttttttatctgactgatgtataatcaatgatccaccctctacagatggctatgaaagcatccaaaaactgtttctatgtgacagagcgcatcatgctccaaacggactgttttccgtactattaataagactattaacatactttctctcaaacccttcgtttcaatcataagtcccacttcaagactcatgaaataatttcataaaataaacaggatatgtgaatggttaaaacattgacctaagcacatctggcaacacaatttatgcatggcaaggtaaagatcattgacactgtatttaaaatgtaaatcttctaatctcccaaaatcatgtactcactgttccagaaacatttctagaacgaaccagagctttcaggattagggccaagtatattatagtgaattttaatgttggcttatggatctgatatctgtcatttacttactttatgacataaagacagacttatctgagtagaaaatattttaacaacttatgaaagcaaaaaattgatatttctaagtataattactcaactatgaaatcaaatatcaaatttttctactgaatgaaaaattatcccctcattctccattaagtattgcctactagctatacaaaattgtacggcttattactctaataaagaaaaacaatataaagtttattttactactgttaactaataaactaaaaccaatttctaaatcatcattttattctactgaaattcgcatacatttttaaaaagtgaataaacagcctactcagtagaatttttgtttctcaagattctaataagaacttagaacaattttatcaattaaaaatgatataaactttacagcctcagaatacatcacactaaagtaattttccaattggtaagctatatttcagagaatcctgctgtctttaaaatcctatcataactatgtaataatacaaactttatcaattatattcaatgaatgagaagctagtgctttactgtgaatcacttggaagttcaccttaatatttactttaggcttgagctcaaaacccattcaggacaaaagactctaccagcccttcatggatatctgtttatcactactggcttaaaagcatgccaactgattggggaaaattttgcaacagatttaaaataaggaaggagtcacagagcagatgtacacatcaaaattctatagcatactcaaatttaaatgaaaacgattagaacaatgtcaaaaaagtttagtaaataaatttgggatgtttgtgtacttatcagaacctcataactgcatataattttgtaagtatattcaaaattacagttattactgaccagtgtctttgagtaaaaagcaaaagaaagttatttgcttactaattttagaatttaaatatcatatttcctttaaggtttaaaactccttttctgtttatttccatttcagacacgaatagtacttttgctttaatttcaaaagacttgtaaatggacagtcttcactttttcatcaatctaatcagcagaatactgagactacgaagttaacatgaacaccctccagtggctggctctgcagcacaacagaaacatttttaccctgaactcggatttcactgccgatatttctgaatgacagaaaatttggggcttatacaacagattacaatcatataaattttggtaaaattccaaactttaaaaataaaaacatctaagtcgctactttatgcctctatttgcaaaattctcatgtcaaaattttctctaccaaggtgttaagatactattttaataacagatataaaaataattttaattcccttttaatctgttgtcatttgtcattattaatattcagaaactgaaataaaactctataaagtaaaaggggctggaagaaaattagtcaaaatgcaaataatgaatccttatgggaaaaaaatacatttgtgccgtgtatcaaaagtaacattttttaagtactcattcaatagtaatctcagtgaaacactgtgtactgagagtacaattccctatacatttgatttaatcttaaaagtataatacacaaatacgttggtaggaaatagctgtatttttaagaaaactttcactaaaatttatttcagtttcaaagagaagtaccatattcctattaacattttaaatataaattgttaaaatcccgagtactgacctctattacagaaaacaaaattggtttaaaaatacacagtaacaaagaatggtaataaaataaataaaaccaaaaaagtctatatttaactggctgctcagtcattagaaaggtgccccataactaccatatgttactcaaatatgttatcacacctacaatctcatcatatgtctcccaagaaattaattagctctaactttttcaactttgacaaaaacgtctgcatcagtcagattactagctgttgcaaacatttcaaaattcaaagctttctccagcttgtatttaaccttttaattactattaatcatttagcaacatttagaacagcattcattagacagatgtctaattctagaattctgaataatgtaaattcatttatacatatatttacttttggtgcatatttattgatgttaaaaaataatccaaaaccacttattgatacatcatttcacggctgtgtttagggtaaagagaaaaatacctaaaagttttacttattctaaaaatctaaaaagtcctaagtatttgagattatatggcttacagtaatacatttaatgtgtataaaacttatttaaattttaaaaagaaacaagaggacttgttaattttaaaagcctttataagttaccagcagtaaaaagaaatagaagtgactaagaagagaattttcataaatatcttccttaccaccaaactttcaaaaggaaaagaaaaaaaaatactactattactgtttgattttgaaccgcaaacccaggcaaccctcaaccatgtaaaccagcttccatctccaccactttatttaaactaccctggtaaggctaccaatgacttcctaagtattcatttcacaaatatttattgagcgaagaacaaaaatcccttcttatagagtttacattctagcgggattgaaagagaaaattaacaggataaataagttatatgatgtattattagtaggaagtgctaatgtctcctgattcccttgttaaccaaacaaaaattaaacaataaagtttgaactggcttcagtaaagtcacagaaaacattactaaattctcctttcaattatctctgctaacaaaataatggataatctaaaaataatctctatttagtaagaaattagatttaagttacaaagttactcctcaggccgaagtaaacgttcaagttaatcagaatgagggcagcctcaggaacagccaaaaataccctgctggcagctgtcttctctttgcagctaccaaggtttttacctactgccacagaaaagggcacctgtgaattatacaattttttggctgaaaagaaccttaaagatatcaggtgtcctctacaaagcttttcttggcctgtccaaagaggtttaagcatttcttcctctttatttccaaattccataaaatgcaggaattatgtctttatttgtgcctgtattctcaaaacttattgtaagtctggcacagagtaagtttgagtgaacttttaaaaacactattttagaaaatcagtctggtagcaaatagagcaaaggcttaaggtttgtaatcactgttaaataatttgtattacatatatgtgcactgctctcaactggtgaggaggggcatccattcatattcaataaacatttactaaggccctactgtgtgtaagactaccattacagagggtatcccagggggagaaagaaaataaaaaagaaaattaataataattttaaattgcaattagtcctatgatggaaatgtacagggtactttaatagagaatctactgtcttcattggcttcacaaagaattaagattactttatacacaatgttctgccagggaaaggcaagaccttaggtagatattgcagtaatacaggtaaagagattaggagttcaattaacatttaacaaacattacaatgtctcatgttctatggcacaaacataaacaacccccaatctccaatctcagccactcaagagcttgaattcaaatgaggaaaagacacataaaatattatcttgattgtggagaacacatagactttatggaatcacagagatgaacatttaggcaactagagtagtgaagaaaagtttcctagaagaagaaaatgcctagaataggcaataaatgaaaacataaatagcatgtattttgaaggaataattaacagtagaagataatagcacgtgcacaggggactgaagtaggtagaagatatgaatgtttctagtctggtgatttgtcagtagaggaaagctgaaaggaaattgatattaatgaaaaagaagataatctcagtttttaaaaatctgaacttatgatgacaatggcatacccatggggaagtttttttcaactacaacactaaagagaagttctttgatttgttattttaataagtacctggaattcactgatacacaaagaagatttgtagccatgacagcagaagagctaagaatttgcagagggcagaaaaggctcaagaacagagtaaggatgggttatagtcacattatgtaggtatcaaaagaaagtatgtcagtaaaagagcacagtccaatgcagcaatgaaacaggaaagccaaacatcagggaagccatgggagatgaatgtttcaatgaggagggggcaatcaataaattaaatgatagacacacccagaaggcataacagagttaaggccattggttatgataaaaggagataatcagtggctatagagaagagttttatcatgcctatggtttcgttgatcataattaatcacaaagatgagcatagactaatatatgaaccacattctcataacctcaattttattatttttataaacatacctaatatttattagaatggatatataagcaaataaaaaactatatagagtatttccactaatagataactttttaattaatacttcacaagaaagaagtattttcaagttaaaaaaatacccaatagtatatattttttgaaagatttgtcatttagagataaaaaatttacatatgatacagtatctgagatttgcttcaaaataacccagtgggtaaaggagtaagtggatatatagataaaataagattggtcatgagttgaaaatttttgaagctggtgatgattacatgggtgctgattatacttgcctctactttggtataagtctgaatttttttcttaatgtcttattgcctaccaggaaacagaaatattttaattttccctaattatatttactatttgcttacagggttctgaaactaatctcaaactgtcaaaagtaatgaaaacggtaaaatttccataggatcaaagcttagaaaattgccttataaaatatatagagagggggaaaaaaataaagcataaacaaactctagaatttagttctggcttcaagaatatttaaaattataaaatgccataaactataatttaaaaatatttagaatcaaaaaataaaaaataaatgccctgttttccccagaagctaggagatatacatacatatatataatatatatattttataacaaatattatattgctatggttctccatggataattacattacttaaggcaaaaagtctttgacaaaatcttacatagtgacacaagtaggagcttatacctgttacagctaaaattggctttcagctgttaattttaactgatatattcttacatgtttcctcatttccattgctaacagttttttcacatgagtaactccaattcatttttcaggtctctgttgaaatattacttatttcaggagtttgctgtcaacttcacacagtaggtcaaaatgtcattctgtatactcctacagaacccttctctatccctatcaaaaacagttcattttagttaggtgccacaacttttaaaaaactgagatataggccgggcgtggtggctcacgcctgtaatcccagcactttgggaggcagaggtgggcagatcacaggtcaggagttcgatactaacctgaccaacatggtgaaactccatctctactaaaaatacaaaaatgagctgggtgtagaggcatgcgcctgtaatcccacctactcaggaggctgaggcaggagaatcacttgaaccgaggaggcagaggttgcagtgagcaaagatcacgcctgtgtactccagtccgggcaagacagtgatccgccacaaaaaaaaaaaaaaaaagagagcgatagttcacataccataaaaatcgccattttaaagtatacaagccatagtttttattacattcacaaggcagtgcaactaccactactaattccagaacttttcatcgccccaaatataaatccagaactcattagcagtcattctccattccctcatcccctcatctcctgaccatgaaaccactttctgtccctaaggattttcctattttggatatttcatattaatgaatcatacaatatgtagccttttgtgtgtagtttttttcacttagccgagcttttcaaggttatttcatttcttttctgtctgaataatgctccattttatgaataatcataatttgcttatccactctacagttgattggacatttgtggtttgggaggcaattacgaatactactactacaaacattcacatacaagttttgtacaaccatatgactttgatgcctttagaaatacacccaggtgtagactgctgagacctacaactctatgttttaagtttttgaggaactgctgttttccaaagcagctgtaccattttacaaacctaccagcagcgtatggggattccaatttctccatatcctcaccaacactgtttatcattgtttacagacatcctaataggtgagttgatatctcacatgattttaatttgcacttctctgatggctaatgacgttgagcatcttttcatgtattattggccatttgattatcttctttggagaaaatattcatattgtctattcagatttcttaattgggttgtcttttcattgttgagatataagaatttttaatatattctggatactaggcccttatcagattcatgatttacaaatattttctcccatactctattcttttcactttcttaaaaattgttgtttcctgaagaccttctcactttcttgacagcggcctttgacatacaagttttttattttgatgaagtatactttctttttcattgactgcttgtgcttttggtgtcaaatgtaataaaccattgcccaatccaaaattacaaagattcacccctatgttttcttctaagagttttagttcttataatttaggtgtttaatacacattgcattaatttttacacatggtgtgaggtaaggagtccaaattcattcttttatatgtggaaatcgggttgtcccatcatcatttcttgaagactattcttccacactgaatcgccttgccatccttgttgaataccaattagccatatatgtatggtttaaattccggattctcaattatattccattgatctacttctctcctctatgtctctttttgactgcacctagcacagtgcctgaaggtgagaagcactcaataaagatttgtgagttgaacagccaactccatcaatagtaaaatgatagaatttctggggtaggaaaagccttagagggcattatcctatcccattatttaataaacaggaaaactgaaacctaagagaggttaactgactaactcaaagagaacaaattaatcataggtcaaggtaggacctgaatttcagtctcctaattccaatccagagctcttgccatagtatcatactttttttcaagtaaaactaattgctttaacatccaccaatgtgcctgtctgggagaagctgcatgtatatgagaagacagagataggcatgtatatgtaagctcaatcagagtggaatcctttgtatcaccaaaaagccttacaaccaaaatgtgccagaaaatagtataccacagaatacaatgttcctttccagacagctgtttcttaacttcattttgtgtttgagagatacctagtcacacttttaagcctggagattattctaaatagaaaaaaaaaaaaaacatttttgggacagcaaaaatgatcaaatattcagggacctagttccattactctgttctcttctacatttcccaccaccgttgtcattcttcattcattactgttttaaagactgtagaaacagagtctgcctgcttccaaaagccagagaaatttaaaagctggagagcagagaactaaagggaaacaactgagaagctctgagagaagtcttctaaaaagatatatggggggaggagaatccacatgataatgcatgatttcagggaaaaaggaagaggctagatgttcaagctaaatactgcattcatatgtacatgtgagggaaatgctgtttgtgcaaatgttgtatatgtaaaatgtataagcagaccacgaatgttcttgtagtcaaaatatttaagcctcagttgaaactacaacctcttctctgaatctttcccagagtccctcaaatgcagttaactattcctttcctattgctcccactcttcctactacacacctccattactatgattattagagtgtattctattaattacatcatgtttgcctccctcctaaactaccttctcattgagggcacagaccatgtgttttccatgttctattctgtgcagaacctaacatagccctggcacatgtaagtactttgtaactctttgttgaatggatattttaagactgcttataatactgaatacatctattctaaagtgttgataacaagaaatttgttaattcttgctgtaataattccaaacattattcacacataacttgccaatacttacttgctctaagtacaaacttcagagttagctatctgcaaaaaacaaaacaaaacaaaaacctaacaatatatttagaactgaatattgtagttgtcagtcatctctgctaacaaggcatttctatatactcttagctaaaaataccacaaaaggttcaagtaagactaatcaatgacaagcagaatggtctcatgtggtgattcaaaaagaaactggatgccatgctacctgacttcaaactatactacaaggctatagtaaccaaaacagcatggtactggtaccaaaacagagatacagaccaatggaacagaacagagccctcagaaataataccacacatctacaaccatctgatctttgacaaacctgacaaaaacaagaaatggggaaaggattccctatttaacaaatggtgctgggaaaactagctagccatatgtagaaagctgaaactggatccattccttacaactcatacaaaaattaattcaagatggattaaagacttaaatgttagacctaaaaccataaaaaccctagaagaaaacctgggcaataccattcaggacataggcataggcaaagacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaaagaactcaaacaaatttacaagaaaaaaacaaccccatcaaaaaaacaggcaaaggatatgaacagacacttctcaaaagaagacagttacgcagccaaaagacatatgaaaaaatgctcttcatcactggccatcagagaactgcaaatcaaaaccacaatgagatatcatctcacatcagttagaatggcgatcattaaaaagtcaggaaacaacaggtgctggagaggatgtggagaaacaggaacacttttacactgttggtggcactgtaaactggttcaaccattgtggaagacagtgtggcgattcctcagagatctagaactagaaataccatttgacccagccatcccattactgggtatatccccaaaggaatataaatcatgctgctataaagacacatgcacacatatgtttattgaggcactactcacaatagcaaagacttggaaccaatccaaatgtccaacaatgacagactggattaagaaaatgtggcacatatacaccatggaatactatgcagccataaaaaaggatgagttcatgtcctttgtagggacatggatgaagctggaaaccatcattctcagcaaactatcaccaggacagaaaaccaaacaccgcatgttctcactcataggtgggaaatgaacaatgagaacacttggacacaggaaggggaacatcacacaccaggggctgttgtggggtggggggaggggggagggatagcattaggagatatatctaatgtaaatggcgagttaatgggtgcagcacaccaacatggcacatgtatacatatgtaacaaacctgcacgttgtgcacatgtaccctagaacttaaagtataataaaaacatatatatataaaaaatatatatatatatatataaaacaaaaagaaactgaagaatcatctctttagagacatgtaaaggaattctggagggtaattaaagatattgtcatgttcaccgagtatgagtaaaacagaagagtaaaatgactatgaaatactggcttggtggtaaaagtagacgctttgaaatctgaaatcctgattttaatgatttacctccactgtgacctctttaggaaggtcacttcatctttctatgcctctttcagtttatctcttataaaacttgaataagctgtagtcccagctactggggagggagaggtgggaagatagcttgagcccaggagttccaggctgcagtgagccatgaccacacctgtgaatagtgactgtgccccagcctgggcaacacagtgagaccccatcgccccccacaaaaaaaagttttataaaatgagaataagaatgtcatactcacaagctcattgtgagaatcaaattatactgtgtatgacctagcacagacacccagacactagcatataagcatttaacaatgttaatttccttcccaactgacaacaggttgtaaattaaggagcagactcaaaaagttctcttctctataaatatctcccctaacagacgtcaatgtttgaattttaccataagaaaattctgtttggactttcaagagtcccaattaaatgtgaaacaatccatcaatactctagtgtgtttattcatcatttttaagataacttaacaaagcctacaggtcttggagatctcttttgaacagagtgaacagagaaggatctatggatggtgaccattacatgaggagtgtgaaagagcaagaaaaaaaaggtcacaaaagggtcctagagacaaacttttcctactttgtagtatttcttactattagtcccatctaacagaataagctctacataaattcattgaaaattcataaattcattagtaaaccagtatatcaatttaagtttattttttacactgtgaaatataaacacctgccatagttctacatactacaaacttttcccttttccacatagttccacatttgcaggctccactcctttcacaagaatttttcctgtgtttataccattgctacaatactgctttgtgtataaaatcacagctttgagttaatgtctataaaattgatcttgggcacagatcatttttcttgtgaaaaggtttgtcacctgatggttattttatgttcatgttaatcagagactgtctctctataattgtttgtattttttctctcaagtttgatttctgtggttccagaagcatacctgccttcttatcacaagtaaaatagtatttattaagagttgaaatttttgttgtttaaaaaaaagaaaagccccaaaccacaatttaaggatatctttttaaccactacagccaaagaaaagatctacttaggatatactatttgctctatgctttcccaaactgtcaactgcatgtattttggtaacatcctagtacatacagatggcatgatagctctgccatataaattattaataaaattcacataaggaaaaaactcaaaaccattacattgtatttacagatttcaccaagacaatgtaatgtccaaatttcacattgtattccaattattattattattgagacagggtcttgctctgtcacccaggctggaatgcattggtgcaaatatggctttctgcagcctcgacctcccaggctcaatggatcctcccacctcagccacctgagtagctaggactacaggtgtgtgccaccacgcctagctaatttttgtattttttgtaaagacgaggtttcgtcatgttccccagtatggtctcacacttctgaactcaagcaatcctcctgcctcaaattcccagagtgttggcattacaggcgtgagctaccgcacccgtccttgttcctattatttgtttgtttgtttgtttgttttgagacagagtctcacactgtctcctgggctggaatgcaatggctcaatctcggctcactgcaagctctgcctcctgggttcacaccatgctcctgcctcagccacccaagtagctgggactacaggcacctgccaccacgcccagctaattttttgtatttttagtagagatggggttttaccttattagccaggatggtctcaatctcctgaccttgtgatctgcccacctcggcctcccaaagggctgggattacgggcatgagccactgcgcccggccagttctaacccaaattctaagtcactcacccaccggccatcttatgaatcctgtgtctcctccccacctgtgggatccaccaaagaggactccataaagcaaatgtggagacaatgactaccaaaaacgaaagaataggaattcttaacagctccagaaaggctaacaaaatcagtcctggactcattaacttagagaagaaaaagtctaaatccaaaggctagagaacagaaactgattatactctaattttaaaataccaaaatatatttaagatccataatgtttaatacagaactttacaaaatccagcaaaataaatttagtattatttatagacataaaaatggtacttctgctttcccaggctcactgaaaaacccgatctatcaattaaatcagagaaaagaaaataaaaaataaagatttgaataaaaacaaattaaaggactgcattttaaaggccacatagatataaagaacactaaagcatctcttttcttctatttacagcatactgaggattcatccataaacctgaggttgacaaccatcttcttctctactgatacagtgaaggaagcatctctccacagcatgcctacaactgtctctttcttcctacattgcccttcttaatgaatgttatcacatactttccatcaatgaagagcaaaatcaccaaattagttctaatttttctccactagcccatatgcgaaattttaggccaagtcaaaatgatgatgatgatgacaggttaaataagacattttttatgttagaggcacactgctgcatgctttccataaattaattaatcctgcttgtctccactaaagactgtaacaaaatccgtatgttgaaacgctaaccccctagtgtgatatttgaaatgaggcctttgggaaaagattagagttagatgaagttcaggagggtggggccctcaccctcataagagtagtgcccttatcagaagagacccaaaagagcttgctcactctccattatgtgaggcacagcaagaagccagaaagagagccctcaccagaaccccatcatgctggcaccttatctcaaacatccagcctccagaactgtgagaaaacacctagactatgaaattttgttatggcagcttgaacagactaattcagatggaaactattatttcccccattttacagaagaaaaaattatagcttacacagactaaataacctccctacagtggatccaagagatagtgatagggccagaatttaaactcaacttttaaccagtactgttccgctgatgtctctgatatgtctgagtgcctaaatgtatcatgagttgtgctaagtgcaataaaaaaagataaggtgcccttaaggaattcgtatatctaataataatcaagtagtatagtcaaacacatgaactgacaaagaatgacttccttgaggtctggcacctaagaaatgtttggtgaaataaacagaaaaccatcagacagtaatacaatgtaataagtgttacccgagtgggttaaataaagtaaaacaagggtttccaggaggaagcaattgtggttgtgattaaggcaaacactttaacagcagtcctcaacctttttggcaccagggaccggcttcatggaagacaatttttccatgggattggggggagacgggggcggtggggagtgaagatggtttggggatgatgcaagtgcattacatttatcattaaattctcataaggagagtgcaacctagatctgtcacgtgcacagttcacaatagggtttgcatccctatgagaatctaacaccacagctaatctgacaagaggtggagctcaggtggtaatgcacacctcctgccgtgtggcctggcagggggcagtcctaacaggccatggactggtactggtccacagcatgggtgttggggacccctgcactgtaaaacaggtagggtatgagaaaaattgtaacagaaataaatacaatgcagtcaaaacaggatacagttattaataacatttggaaggaatttatcagggatcactagtggaagtaacatataagttgtctttcttatgacaacttgagatgaatagaatcacactgcttgaatgagacataattctaggttgaagggactatctggtcaaaaacatgggatttggaaatgtggctggctgttccttttttgatcccatattcaacactgtactttataatataaaatatattaacaggtgccccatctctcatcttttttggaagacattacacaaagcataaaatcatcctgaaagtacagatactgattcctcgttcaaaagcattaaagaatcctacttcacccacaagataatattcaaattcaaattccttagactggaatgttagacctctcacaatctgtccctgtttttccttttctccctgactcaccttgaggcatgtatcctttatactgaagctacccctacattatctggggctcctaaataggccctgttagaatgtttccatctggactctgggaccatctttaagattcatttcaaagactggcttcctttaaaagtatgaccttgcctattacctcacttagtacactctctcttatgttagttgcattcctgcatgtctccattaaagactataagctgtttgaggcagggcaactaccctgcagaaaaagacatcaaataacatacattaatgcttttctactgggaatacagtgaaaaaaatacactaaagcaaatctttggttatctgtgtctaagtacaataaaaaagctaatgattacaatgcaatataagagcaataatagacaattatacagagtattatgactgaatcactcaactaagccttgcaaaggttgaggccagcttcccagagaagatgacacaaactgattcttaaaagatatgaagaagatacaggtaaagcatacacaaatataaaacagtaccacatgtggagaactactaccagaaattcagtgtcactagaatgtaaaggatgaagctggaagttgcagagtatcatcctatagagacagacaaaaggctttccatactgtgttaagaatactgtgctgtaggccaatggtttagaggtacaaagtataagtgtgtgctgtgtcaaaactaggtttaagttatactggaaatcattttttaaaactgaattaaacagattgtacatgtgtatgtcaaaaatcaaacgttaaaaaggtatacagtaaaaagtctcatcacacccatccatctgcctgtttaaccctgctttctggataaaatattagttgtttttcattccagagtttatgacaatataagcaaatacaactataacatcttatctcctctcctttacataaattgaggtttttccatgattttccatataaatactattcttccgattcttttttttttcttgtcactgaatggacctcatcctaccattctttttcgactatgtaatattccattgtattgctgtaccatgatttacttagccaatttcctattaatggacatttgggcttttccctactctgatgctgtatgttgtcttggcatatatgaagaaaatccagcctcatgcagatatgaatagaaaaagggagaaaaatgttaacaaactttttggattactgttgatactattcaaatcgtttgctgttacacacaatagttgtaggaatcaccttgtatatatcacataacaaacattcctaagtttacctataggatccacttccagaaacgagaagatacatttgtaagtttgatatatattgtcaaaccgtctctaaagtttgtagggactcctacagtgtagattctcctccagcaatacctgagcagtgacaatgcctggttttccagagcaaaaagagaatcctagggaactctaccctttaaaaatctcatccaggaagaattcaaaagaagaatgagaagaacattcaaacagatcaaaaagaaacaggagatcataaggttccaggggacaagcaagagtggtttctcactagtgtcaaatacacagaaatatttaataagataaataattaaccaaaatacaaaacctaaatgattaaaacagtacggtattcatgcaaaaatagaatggatcaggacaggataaggaaaagaaaaatactgcatgaagaacaaaggtaaataaaagaattaaaaataaaggaaagttaatactattttccactaagaagaaccagagctccctagagagctgcttctagaggtaggaaagtatatgacgagactggaatatcttgttgtcccagcaagtcctcaaaaattgatggagacatgtcaaaagaatttaaaagccggcctgaaagtgctttcatgggcccaatctagaatcatttaagcatttcaaaataaatgatgatagtaaaagattataacccattgagtaagacagaattcacgagggagaaagaaatttcctccttatagtaaaaagccaactaaaatgaaaaaggaatgtcagaattagaaaactaccataaatcattaataatgtattcaagtaagaaccctaaatggatgccaaaattggtgggccaaagtttgaggagcaaccagatattcacataatctcaaagaatcatacgacaagattcctattaattataaagaaggaaaaataactttataatgaagaagaaagttggtaaacactactgtaaccaggtgatcaaaattaacattactaggactaggacaaatcaatatgatgtgcctcctgattaaagattattagaaagacatggcaattgaattcaacatatgattcaagattattttttgtagaatgagagctataaaggcaattattggcaatatctgcataaccatattatatcaatgttaatttcttgattttggtaactataattatgtaggataccacttttgtttcaggaaacatgcacttaagtatataagactaaaggaggcatcatgtctcaaatttaccctaaaatggttcaggaaaaaattctatatatttgaacataaatatatttaagtatttaaaaatatgtttaaaatctatataaatatatttaaaatatatacagaaggggagaaagagagggaacagagggaagaaaggaagaagaggaaaaaagaaagataatacaactatggaaaaatgttaaaatttgagtaatgagcatataaactttgtaattgttctaacttttatacagggctgaattatgtcaagataaaattttcagtagatctggaattataacctagattgattctaactccaatttgcattcaaatattcctttgaatgaatccttccactgagtgaaaaattttaagaacacaattgttcctttctatagattactactgtttaaaaaaataagtaaataaacttatgcctagggaaaaaaacaaacactaagaggaattacaccaaaaatgttttaaatttgttttaattgcaaagtagggcataattctttttaaaaaatccaaataatacagttaaagtctcttctatggcatactcctacactcttggtaactactgttaatagagctatacagccttctaaaatttttttctatggaaaaaattatgtatatataattttctttataaacatgataccacatatataaacccttgttttactttacatttttaaagttaaccgtagacattctttcatgttagcacataatctttttttaatggttggttagaattccatagtacgaatgaatgcatttgtccattcatcttttggtgagtacttaagactgtctccaacttttttcatttcatatacaatgctgtaaaaatggggaagcgttggttcattttgttttacttcacattttcctcctctttttatttgttcttagccatttgtacttccctcctctgtcgaatgcctcttcacattctttgtcctttcttctattgggtcatttatctttttcttaatgatttatagaaacacattgtataagaatattaaccctattttttacccagtatataccttttgttgcagagatgatttcacttttacaatatcaaatctttatggattcctaatgccacaataatgttgatgtttgagtgacagacctatggatttttttaacagttttttaaatgtatctaatacctttagtaagtatctattactttttaagttaaaaaggtcatatttttatattccttaaaataagcaaaattccaacaagatttttgatgaaacctggaaaactattctaaaattcacatggattgatggatttatttaatcattcctttttgagacagggtcttgctcagtcacccaggctgctgcacagtggcacaatcacagctcactgcagcctcgaccttctgagcccaagcaatcctcctacctcagccttctgagcagctgggactacaagtgcacaccatcatgcccagctaacttttgtattttttgtagaagtggagtcttgctatgttgttcagcctggtctcaaattcctgggctaagtgatctgcccaccttagcctctcaaggtgctgggattacaggtgtgagccactacacccagccaactagtctctcttaatggccctttggagacaagagaaccaagccaaacatgaagaacaaaaaggggagacttgcctaagagagatcaaaacttgtaaagcggtattggcctaagaatagaaaaataggctacaggaaaacatcttaagtctgcttgggcaactgtaacaaaaataccataaagtagggagcttataaacataggaaacaacttatttatttctcatagttctggaggctggaagtccaagtacaaggcaccagcaaattcaatgtttgggaagggcccattcttcatagatggcacccttcttgttgtgtcctcatacagaagaagaagctaactacttcactggggtaccttcttgcccccatttatgcaggcagagccctcatgacctaatcacctcacccaaagccccttttcttaacactatcatatccgggattaggtttcgacataggaatttggggaggtagggaaggacaaacattcagatcatagcagagaagtacagagaacccagaagcaaacccatatataaatggaacaatgctgatgaattatttaacaaatggaactgggacgattagcgtatctttgaaagaataaaagattagattcctttaacaccatacacaatacacgtatgggcactcacgcatgcacacatacacaccccattctgggtggattaaagaagcagtaaatgtgaaagaactttaggtattttataaggaaatatatgagactctggtagctaccctccaagatggcttctaatgatcctcacaccctggtattcaagcctgtgatattgtaatattacaagaaatatgtatttttatcttcctcccaagctcctgggtccctagcacagagctcctaaagctcttcccgcttcctgagtaataggagtgataaagcatcttttattataaatttggtctcaatccccagttcctaaaacaagagcttctaagaatttctggagtgacaagagtgtcctttgtatattaatgaagtgaactggtgagtggggtccctagatcggttcaggataatggccagtgactagaaagactaaataaagcatgattagagggttagaactttcagcttcacctcaccctcaacctctgggaaggaaagaggagctagaaatggagttgatcatcgatggccaatgatttgattaattatgtctacacataaaagccaaaaccatggggcttgaagaacttctgggttagtgatggcatccatgtgccagcagggtggcataccctaactccacaggacagaagcttctgtgctcaggccccttctgtacctcaccctatatcttcatctggactaggtataactctgggtaagtagggaaaaatgaggagtaagatgagagaagaatgcataaacttcagttaattaaggtgaatttttaaaaaaaaatttaaaaatttgtaaatgaaaagttaacttaaaaaatttttaattcttaaaaaaaatctggtgaaaaagtacgacaaagctaggacatgggtactttagtgctcactttattcttctctatagtcttctgactgcttgaatagtctataacaaaatatgtttaaccaaaatgaatggtaaataataacttagtcaacattttcagcagaaaagatcaaacgagtttatacaattgataatagaaagcagtaccatacacaaacacaaaattaacaataagaaattatgctagtattataaataaacccatgggaaaatgtacaaattccagctttttagtaatttttcatccaaaaaatacctgttgaatgctaataagtccagccattattctagactctgggaagacagcagtgaacaatacagctctcatattaatacactgaacttatattctaaaaggcagagacagccaacaaaaatataaacaaataaaaaagatgctgataaatgctatgaaaacaaaatggatgacgtgacagagatgagggagggagaaaagatactttagattgggtgttctaagactctctgagaagacacccgtcctgagaagtacataatgaaaaatccttcaaaaagctaaggaaagaggagaccaggcaagtgcagaaatcctgacatgagaacaaacataatccatttgaggaacagaaagatgaaagtgcctagactgcagggaatgagggggtgagtatgagacaagattaaaaaggcagacaaggaaacccaggggtcaatccaggttttaacggaattttaaagcttataaaattgggggaacagccctcttcaaaaaaaaaaaggaacataaaactataaaaacaaatttaggtcctaaattgaatatttattcagaataagaaaggaaacgacatcaaattacaaatttttagaaactgccaatcacataaaaaagtactaaattagagtctggcccctccgagttctggcaccaggcaagctcacatccacagccggtgcaccagcatctccctcatgccgggtgatactgccaggtctccaggcaccacaatctccctcacgctggacactgctctctgggcaccaccatagccctcatgctgcacatgctcttggtccacgcacagtagccacagccagcagggctggccttcacggcctcctgtgctccccctcccacccctaggctggagtgcagtggcacaatcatagctcactgcagccacaaaggcctgggctcaagggatcctcctacctcagcctcccgagtagctgggactacaggagtgcaccaccacgcctagctattttttattattatttctgtagagacacagtctcacgatattgcccaggctggatttcaactcccggcttaagtgatcctcctgcctcagcctcccccgtagctgggattacaggtacaagccactgtccaactcaatttttttttttttttttttgagatggagtcttgctttgtcgcccaggctggagtgcagtggtgcaatctcggctcactgcaagctccgcctcctgggttcacaccattctcctgcctcagccgcaggtgtgagtagctgggactacaggcgccagccaccatgcccagctaattttttttttttttttgtatttttagtagacacggggtttcaccgtgttagtcaggatggtctcgatctcctgaccttgcgatctgcccgcctcggcctcccaaagtgttgggattacaggcgtgagccaccgtgcccagccccacctcaattttataatataattttctacacagagaacacagaaaatagttgtcttttgtttacaatagagaatcaacgttttttttttactacttatagtttagaactaaagtttcagcttcacaactattggtgatgctatgtaaatgtctcaaattactgaatttgtgaaaacctctcatgtttctttcacatgtgagttacaagaagattatttttaaaaacttgcaaaaagtcaatcttggtttctcgtccattacccacagtcttccagtgttggctagatgtgtcgtaggatgcgttcatattgctatgcaaaccttcggccaagcaccctataaccatgccagctgcactgccagagtgcacagccatcaaattcctggaaggtattcttacatggagtcagctagcaacagctaaactttaaaatgactgcaggtcacagaaacatatcccactcatcttctccttaggactccagaactgcttttgtccatcccaacacagcctgaaaggatagggtgtgtgacaggaaagaagacaaagtggaaaagtacagtggccttaaccaatttagtccagcttcagaaagatactctgcaagtgagaaaggcctatgctttatgagcttcaaggtaaatacctctgtccagatcattctgagccttaaagatcatcaagaacagttaggattttttcttcttcatgagacaagaaaccagtggagggttttaatcaagggatctgaactatgttttgttaacaaaaacacaagggaaatgcactgacctaaggttatcctctaaccctgatcaaaaagaggtattcaagcacaaagcagaacaaagttatgcttccatctcctgaaaatctgtgtttcctctttttccttatctctggattatagatatacacaaatccagtcatcccataattttcccaaagacttctaattgaaaatagaagtaaaaatttctcaacctacaagtttgtaaaaaaagaatagcagtctttaaaagcaggatagtcagttatttaagtgttgttctacagctattttaggaatggtggtattgttgttcctagctgtgcagccccaatcttaatagcctggcctttccatcagctcaagaaaccacaaatatcttcaattaattctgtttatacttaaattagcaaaagttaactagtaagttcatttctactaacaattaagagctctgaatccaacaaataagtatgtaataagcaaataaaagtaaaccagtcaatcatgaaacttgaagttattaaaagcacggggtgggggggtgcgcggtggagatggtaaaaatgattagaagctgttgaaccagaaatgctggagggtgatggcattcctcagcccttcctactcacccacaggtctcttgttctgcccttccatccatgtttggggagaagggtcaagagagaagcacacagtagcttctcactacataaagtcagctctgctactgacatgctaaaaaagctgtgaagaaaaggaaattaaagaaggcaaaaaaaagaagaggcccatgtaagaactgacctgagaacacagtgtgtattctaacaagcacagaagagcataatacagatacaaagtttaaaatgtaggagtgggaaacacagaataaaaggactgtaggattaggttaatctagaaaaccttggtcccagagtggttggtgtggaataactgccagtcatcatctcatccataagtaagatctttgtagctaaatcataaaggcaacgacaaagtgaatttacatttttcaaatccaattacacacgtgaaactttaacctagtaagacaacatttcaatgagaagctaaaacaattgtaaaaattttgatctagaaaaatatctgataaaggtaaaaataaatgttacccatgcacatttttttaaattaactagatctacaaggcttgttatgaaaaactagtcccagctccctctccaatatttccttttcccaaaagctttctttattcagtgactgccagttgaggaaatttgagatatagctgtttcctggtcctggcatcctccacacttcccacccccgatgtctcaacacaatcctaactttggttagatcaatatttgaggcttatgtcattataactacatagggtattcagagctgaaccaagcagtaaacaataattacttttcttttcctgcataacattttgtttcccttgcaattaataatttgtttctcatttctttagttttctacatacttatctactatatatttatcccaattcaccccagactctccagtctgacaaagctcctttgagtataccaatttgcctcaggtttctatgaatttcatcttctggaagaagtctctccctgtcttcagacttgctaccatctggactgaggaacctaggccaggtacacagctactgtcctaggtgttcctcccactcctctcctacattaatcttcttcctaaaaacaccactgccactctcttccccacctccattcccctcagatcccaccacagaagtttcatgagaaaaaaaatagtgtgtcgacaaagcttggaaaaccttgcaacatacagtcgctttctggaattccctaatgtatgcatttgagaaccctattctaaaaaaaaactttcaattttgattaatccaggtatctctgaaacttaatcagagacaataatctatttttgaggaatacctacctgctaatgatgtacactttgggaaatggtacatggatggtaagctacttgaaggcagggaatatagcttattatactttgcaaactcatgacatctaacatggaacaaaacataggaaaaaaacatgctgaaacaaacacaggtttatataatagtagatgtcatgtatcttggtcatattctaaaagctattccgaaataccaatgatcatcctaggtatattataacaactctatatacatttcatagaatttccactataaattcattatgtgtgagtgcagctatccctgggtattcgtgggggggactgattccgggacccactaaggatactaaaatccacagatattcaagtctcttatatcaaatggtatagtatttgcatataacctacacacattatcctgtatacaggcatacctcgagacattgcacgttctgttccagaccaccacaataaagtgagtaacacaaattttttggattcccagttcatatgacagttatgtttacactatactatagtcttctgtgtaacagcattatgattttaaaatgcacataccttaattaaggatcatctgagccttcagcaagtcataaactttttgctggtagaaggtcttgccttgatggctgctgactgattggggtggcagttgctgaaggttagagtggctgtggcaatttcttaaaatgagacaataaagtttgccacatcaattgactcttccttatgaaatatatctctgtaacgtgtcatactatttatccacagtaaaactttcttcaaaatttgagttaatcctctcacatcatgccattgctgtatcaattaagtttatgtaatattctaaatccttttgttgtcatttcaacaatgttcacagcatcttctcaaggagtagaatccatctcaagaaaccacctactttgctcatccataagaagcaatgcctggccaggggtggtagctcacacctgtattcccagcactctgggaggccaaagcaggaggatcgcctgaagcgaggagttcgaaaacagcctgggcaagaaagcaagaccctgtctgtacaaaagataatttttttaaaaaattagccaggcacagtggtgtgtgactgtggtcctagctacttagaaggctgagaagggaggatcgctttagccagggagttcaaggctgcagtgagctaggatcgtgccactgtattctgctccagcctaacagaatgagactttgtctttaaaaaaatctttttaataaacagataaaaaacagcaactcctcatccattaatgttttatcataatactgcaacaattcagttccatcttcaggctccactgctaattctagttctcttgctatttctaccacatctgcagttactttcttctttgaagtcttgaatccctcaaagtcatccatgagggttgaaattcaactttttccaaactcttgttaatgctgatattctgacctcctcccatgattcatgaatgttcttaatggcatctagaatggtgagtcctttccggaaagtttttcactgactttgctcagggccatcagaggaattgctacctatggcagcagccatacccttagaaaatgtatttcttaaataataagacttgaaagttgaaattagtccttgatacctgggctgcagaataaatgttgtgttagcaggcatgaaaacaacattcatctccttgtccatctctatcagagctcttgggtgaccaggtccactgtcaatgagcagtaatattttgaaaggaatctttctgagcagtaggtctccacagtaagcttaaaatagtaaaccatgctatgaacagatgtgctggcttccaggctctctttttccactgatagagcacaggcagaatacagatttaccataattcttaagggtcctaggatttttggaatggtaaaggagcactgacttcaacttaaagtcaccagctgcattagctacgaccaagaaagtcactgtcctttgaagctttgaaggcaggcattgacttctctctctagctatgaagtcctggataacatcttcttcaccaaatagaagagtgttttgtctacactgaaaatctattgtttagtgtaaccaccttcatcaatgatcttcgctagatcttctggataaattgttgcagcttctacatcaacattgattgcttcactttgcatttttatgttacggagacggcttctttccttaaacctcatgaatcaacctctgttagcttctaacttttcttctgcagctttctcatctctcttcatagaattaaagagagttagggcctgcctctggattaggctttggtttagggaaatgttgtggctggtttgatctacccagaccactcaaactttctccttatcagcaatacggctgtttcgctttcttatcattcatgggttcactggaatagcacttttcatttccttcaagaaatttccctttgcattcacttggctcaagaggactagctttttgcctgtcttggctttcaacatagcttcctcactatgcttcatcatttctagcttttcatttccagagagacgtgtgattgttcctttcacttgaacatgtagaggccattttagggttactgactggactaatttcaatattgttgtgtctcaggagtgagagagacaggggtacagccagttgctggatcattaagaacatacacatttattaagttcatcacctcacatgggtaatggttcgtggtgccccaaaacaattacaacagtaacatcaaagatcactgatcataggtcaccataaccggtataataataacgaaaaagttgaaatactgcaagaattacccaaaatgtgacacagaggcacaacataagcacatgctcttggaaaaatggcactgatagactggctcgactcaaggttgccacaaatcttcaatttgtaagaaatgcagtattagcaaagtgcaataaaacaagctaggcctgtactttaaatcatctctagattatttaaaacacctaatacaatgtagatactatataaatagtcacactgtattgtttaggggaaaataaggggaaaaagtctatgcatgttcagtatgaacgtaaccattcttttttttttttctcaagtatttttgacacacagttgatagaaccacagatgcagaacccacaatgggtatgagaggcgaactgcatacctattatctcaactccactccactggatagaacatacttctctttgcttccaaaattaagtccatcctcaaaaacgcaatacgcctaaaaacaactctgattcattatacctttaaacaacagattactcaaaccagagcattaagtaaaatggttttgtaaaaactgtaaatatatgacactaataattcaacatgtatatcacagtatgagtgcatatactttatgttaatgaacagaatttaaatgagacgaaggataaatggtgaagaaatcttgcccccttccctcgtcaacaattcaggcaaacctaaataagaggagtcacttattccagtccccttctctcaataaggaggagaggaagagaaacattctgcccctgggcggcataaagaacaaactgtgctcctgcaagcttcattcagtagctctggaccaaatgaatcaacatgtttatctgctaatacagctgagctcattttaaagtgttatgcacttaaaaggaaacaaactttttaaaaaacaaaactagtaaaaattagaaagtttttgttgttttagcaaatttagttaggtttatgaagaccaaaaattaacagaataaatcttctattttgtcaaaatgtttattctcaactgaagaagatttaaggaaactcaggctcaaaaacatttgatctaggggtcaaggacagtctgacttcttagttctgccagcagttttttaaagctgcttcctgtactagggaacgttcactgttcttgcacaaacaataataagtcatttatacaaacaccttggttattctttccttttaaattcactggtaataacaaaggctaccatcatgattctaataaacattttgagcttttaccattaaatttctattaatttattatttgtggggaaacaatttattcacttaactcaaaaatatgtctccaatgctgccaatcatgtgcccgacattatagataaaagtcagcaaaagagatacagtcactgccctcccagagcttccagttttgctgacaagatattatggaattatacatctatatatataacccggactatgaaaagggaaaaatataccatgaaagcaaacaacatgatctggccctgggggtcagaggattcctttggcagtgataattaagctgagattagccttacaatcactaaacatgatttgaaacacacacattccaaatcatcctaggagtaggaatgcttacagctacatgggggaggggagaagagtttataggagccaaggtaaaatccatgactttaaaaataaaggtgagagcttcatgtgtacaacaccaagagatcacttatctctgtaggaagaaaagcaatggccattcctagcatactttcactcaaaaacaggtttcgtagctagaactattttccaataataaagccaaacatcagctatcaatctaataatctccaatcatctcaagtcctccaaacacattaaaatgaatttataacagtaaatgtatcacaagcctcaacaccccgtataaacccagtaatgaaaaaagatgtcttaagcttcacatatcacaggtcatctaatgtcagaacagaaacaaacttctagaaatcatcttgtaataaaacacttttcactgtgcaaatcaggagtaacacccgaagtgaagcagcagcacttacaatgtcacacatctagttcagagtagaacaggaggctagagcatggactgcctgagtccactctctatgctttttctaccagcatacagcagcaaatacatgacaagaaacacacgttgcaaataaataaggcagaattttaagacacaaattgcatttcaaaatttttattttaaaattttttttacatatttttagggacagggtctcactatgttgcccaggctagtcttaaactcctggcacaagcagtcctccctcctcagcctcccaaagtattgggattacaggcacaagccaccgtgcgtaactcaaaatttttatacattttcaactgacccacacatgctgcaggctctagaaaacaaatgctccctcttaccacataccacagaagagtaaaactgaaaacaacagctgggcacagtagctcacacctataatcccacatgctatgggaggctgaagtgagaggatctcttgaggccaggggttcaagaccagcctgggcaacacagtgaaaccctgtatctataaaaaaataaaattagccagacacaatggtgcacacctgtagccctagctcctcaggaggcttagaagggaggatcctttgagcccaggagatcaaggctgcagtgagctataatcgcaccactgcactctgcactccagcctcaacaacagagcaaaactgtctcaaaaaaaaaaaaaaagggtgaagaaaaccgactatttattgactccctagggtctaggagctcgactgagtagctcatctactttaacatccattaatcatcacaactaccctctgattagatattattctcattctactgagacccagaaacattagaaatttacttatggttacatagcagaaaaatggtagaagtaggacttgaattcaagtctaaatctaaatccatgtagccattttaccattaaaaagcattttttctttttttgagacagggtctcattctgtcacccagggtacagtgcagtagcacgatcatggctcagctcactgcagcctcaacctcccaggcgtaggtgatcctctcgcttcagcctcccaattagctgggactacaggcgcaagccaccatgcccacctaatttttctgtattttttgtagagatgaggtttcaccatgttgcccaggctggtctcaaacttctggactcaagctattcatctaccttggcctcccaaagtgctgggattacaggcataagccactgtacccagctagtgtttcttcattaaaaaatactatacaatgtgattaggtttccctgggaacttacaaatgcccatttaattgctaatgaaacatattttaaagtttggtctaggataactgccatttataacattatatcaaaaagaactaccaagttttaaacaactactttacaaacaaaatttggaacatattcttaagttaaatgttattcatattttcttttataacattcttttcaaccctgctgtcagtgccaccagaaatgggtgttatctactcctatgaaatgttggctcagacacaagaagaagagtataatgcatgactgcttaagagaaccataaaaatacaagaactacattttaatcattctgatttctccattggtggacagcccattaacagcttcaactgggagagagcatactgctcaaaaataagaacccagcagtccaaatagagcaaagcacatcattaattaaaagaataccagtttttgcacaactacccacaccataggactttctgctttctcagctctgctaaattctgttaccactcacgcaccaggttctcagcttccaatatttagttgacgttgtttgcctgctgtcatctctcatctcgttctctttaccctcatggatttctgcttttatatgtgttcactatcatttaagtggggaaggaaatacatgtcttctctgataatactggagatttttaaagttttcttttgatcccttatggtatctgttttctcccagtgttccaagtatcactccctctccacctctctatgtctacttttttttttttttaatgttggagtcttcccccagatgaccaatggtgttagattgtttgctcatatttaagaataagcccctgaaaagaactaactgaaagatctgtgtgggaaaacagggcttaacgactggtagaattcacttaaggtactctcagcagaaagcctatcagtatctgaagatgctgttatcttcagtcttccacaggagaaggataggacaggcttgactgtgcagttctggaaggagagcagaggaagagagctaacacttctatagttcaggcgtaggtttcccttgatctccttgttttttttttttgttttttttttttggtttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccacccgcctcggcctcccaaagtgctgggattacaggcgtgagccaccgcgcccggccgatctccttgttttaaaccaagcaacaatccacggcccctggtttcaaagtccagacagctcttcattaattttgcaaagaataaaccttgttctcctgaggccagggagttggtagtgaagggactcacccatccacaagggcacatagggagaaaatcgtaggggtccacctgtcagtgtacacagattttccgaccagctcccctgttttcagctccatttctgacccctatcttccttagtatctggtgcctccaaatgctgagactcttgggagcttcggacaaacacagtactgcatttcttacaggtatttttgtgcacttacaggtactgtgtgattcctctgcaaagtcagtcactacctgtccatctgcttatttgaaagaggtatagcagcttctgtctcctgttgtaacctctcccagtctctgatttctttcttccatttaggcagggattaggaaataagaagagatgtacaggtgtagccaatctgtcacttttggtcagaagccctgagagagctcttttgaaatcagctatctcaggatactgacttaaggactaaattagtatttctcaaagtccgatcacagacttgcattagaatccacaaggatgcttgtccacacagcagtctgggtgatttttgcttttgctgttacatggaaatcagattaagtcactcccccacttaaaacttcctaataagcagcttctcactccacttaaaagccaaggtctttcaaagcctaaaataatacggccaatgtatgtctatctctgatcccatttaataccattctttccaggcacttttctctactattaatatattctgacaacactggcctagaccaccaaccagtttattgctatctcagggcctttgcacatgttctttcctctgcttgtaacgttcttcttctagttcttgcatggccccttctcatttttcagatctcagttcaaaggtggacagacaaaatgtggtacatccatattatggagtgttatttagccttaagaaggaaggagatgcggacatgtgccacagcatggatgaacctggaaaacactacgctaagtgaaataagccagtcacacaaatactgtacgatccacttacatgaggcactaaagcagtcaaatttaagaaggcagaaagaatggttgttgttaggggctgagaggagagagaaaataaaaaattactgtttaatggctgcagagtttcagtttcacaacatgaaaaaagttctggaggcagatggtggtgaatggttgcaaaacaatgtgcatgtacttgatgtcgctgaaacgtgcacttacaaatggttaaaatggtaaattttatgttatatatattttactacaacctaaaaaatacttttttaaaaaaaaaagcaagataaaaaataagagttatctcttcaaaagacacctcccaagatcactctatgcaaagctctctctctcctttcccctgccaggtaattatctggcacatatcatggtatactttcttcacagaacttagcactatataaaattatcctgtttgtttattatctctccgccagttacagagtaggcacctgggatgtcttctaacactacctacacaatatggtaataaatatataataggaagacactcaatacacatttggtggctaaatgaattaactgtcttctaggtctcaacccagatctactaaatgagaatcttgggattctcagacattgctttattgggagagaaaacttgctatttatgacccaaatagcacctcccaatcccaacagctagttaggacaatttgacacaaatgacctttaaaatagatattctctgttcttaccacagaatatgtgcttttgattggagggttaaacagtggggaaggtatagatgaaagaggagtttctaacattttcataaaggaatgcctgataacatgacaatatagttcctttaattattcttaaatgattaagcatgtataactatcagaagagcttctacataatcaaatagatcactaaacttctttatgaagtaattcaaaagttaggataacaaaaaaaaaaaccaaaaaacagtttttctttttttttttttgagatggagtctcactctgtcacccaggctggagtgcagtggtgtgatctcggctcactaaaagctccacctcctgggctcatgccattcttctgcctcagcctcccaagtagctgggactacaggcgcccaccaccacacccgtctaattttctgtatttttagtagagacggggtttcaccatgttagccaggatggtctcgatctcctgacctcgtgatccgcctgcctcggcctcccaaagtgctgggattacaggcctcccaaagtgctgggattacaggcgtgagccactgtgccaggcccttttttttttttttttttttaagacagggtctcactgtgtcacccagactggagtgctgcagtggcatgaccactgctcactgcagcctgacctcctggactcaagcgatcctcccacctcagcctcctgatctcccacatagctgggactacaggcatgcaccactacacctggctaatttttaattttttttttttttttttttttttgttttgtagagatgtggtctcgctatgttacaggctggtctcaaactcctgggctcaagcaatctgcctgcctcagcctcccaaagtgctgggatcataggcatgagactttgtgccaggccttctatttatgttcttgatattatctaatttcctacaggattttgttctcatatcttctctctgttatctttccatctcacctggacaattctatagctcactcctagacagcaaacaaacacacttatctccccattctaaaaaatattcactcactcttactacatgttcaacctctaattttctctattcctctccacaacatccagcttttttgaagtctactttctcatttcccattcactccttaaccttcaactccacactggcgaatatggtcatcaaccccttaacacagcagttgctctttcattagtcaccaatgagctcctttctgttactcatcatacctccttcactgttttaatcttgctcctccttttagatgacttaaattctgttcatcgctaaagtatgagtggaaagtggggtagtgaacccagacaagactgggtgtggccctggcttcaacagttattgcacttttctgagctgactgacataggactggtctgtcttcctaagggataactgaactagggcaggcactagatcctcatttatctttacatccttgagctctttatatctttatatactgtgtgcttggcacattaagtagacactcaatggggctgtggaaggtaggaaagaaagaaaatggggagggaatgggtggggaaaaatgcaggaaacaattttactcatctttttatccctaagtacaaagtagaaaagttaaccataatagaacctcaattaatgtttggtgacccttactgaatacatatatactacctattgcatgaagatttgggttttgtttaatttcattgaacgtttacatttaaattctgagaactgcacatttaccacaaaactatggttgtaaaaactatactgttaattatagttacagttgctgactcattaagcaaattcatagttttagaaacatagttttagtcaatgaagcaataaaatatactttagcattcttcaacattcagactaggggtaggggatgataaagagagacagcgaagttaagactcaacatgaaatgaggtagaaataaaaagaacaacactgaagtctggccatagggtggttaaaaggctctgtaattttcctaaaattaactttcaaatatatgacaaaattgtcataaataagttagtctaggtttaaagagcttttttgaaagtctgatttctgttacttaagaaaaaataaaatgtctctaatttttaaacaaagcacacataaacaagctgctttcaataaatgctcttttactatatttcaaaggaaaactatctagcactttggggcacttattaaatagtgaaaagaaaaatatttctttctagttaaaaaaggatgaagacaattcttggggagtggggggatccaagtaactgaattctgtctataacttaaagttcctttttttttagctcttattctctgtcttatttccaagtttctatttcctttacttgcttttaaatgtcagtattctccagagtgctatcctctcatccttctcttaaacatgttcattgagcaatctcatctgtaccagaaaagcacactgtttaggagtataccttccaggaccaaatgtgcttgtgtttgaatcctgaccctactacttgctaggtgtacaaccttagacaagttacttaacttttctgtacctcagtctactcatctgcaaatcaaggataaagcagtgccaaccttacagggctgttgtgaggcctcagttaatatatatcaaatgcttacaatgctgcctggcacataatatgttttctaactaagagtgttagctataagagggccatataattcacccagggcacttctaagatttaaggaagagattatgggccaggtgcagtggctcacgcctgtaatgccagcactttggtaggccaaggtgggcggatcacgaggtcaagagatcaagaccatcctggccaacatggtgaaaccccgtctctactaaaaatacaaacattagctgggtgtggtggcgcacacctgtagtcccagctactcgggaggctgaggcaggagaattgcttgaacccacaaggcagaggttgcagtgagccaagatcgcgccattgcactccagcccagcgacagagtgagactcagtctcgaggaaaaaaaaaaaagagagattatgtataataatcacactggagcgacaagagtaaaccagaactaccttaggcaaattaagacagtatcacccaactagttaggataagccataaaatacaatgatatgcaccatttctgccctataaatatcatataattaacctaataatgttcagttccagttaatgaaaacctagcaaatacttaactattatttctgaaagtgggttcagtaggggtgatggctgaataggtcaaaacacttcagaaacatcaagttaaataaagctaagtatgttggaaagatgaagtttaccatctagcctacccaaaactcactggtgtgctaattgactttatagcttaaactagtcttattttgcagctacaaagttattctgaaatgaaattaaaatgagctactagctttttaaaatataaggtatgttatctatgttattcctcagggcctatcccataatgagtattaaataaacatttcttgaatgaatgaatgaatattaaaaacaatttctattatctctgaactatgagagatatggagattgtaacaaagaatgaaatccttaaaagaaaaaaagataattcaaattttcttgttcactacttaaaaaccattaaaagccatttttgacctaataattccatcaacccatgtatttcatatgtaaatgttcaatgaaacaggacttgccatgccatggataaagttttaaagacggtaataaaaatcttttcagggttattatttcatttaaacactactgatgtttatccagccaacaaaaaagtataatagcacaaagactgccttctgaatactccctagaggccaatcagccaggtgtgagaattctgaggttagggaaactctttgaaacagagttcaagaagagctacttagaaataaagaaacaaattcagatcatgatagccataaagcagaacctgcagaagggagcatcaaaaaaccaagggcagttttgcatatttaccaatttaatctactatttcaaaaaagctgaagcactagtcttatagtagtgacctgcaaaaattatcgagccacatttagtcaacagcaaatatccaatggaaaatctaatgcaatttttatatggatgctactggaatcttatatccaaaaactgaagaaggccaaccgaaaccccaaactacaattttattctttctgatcttatgttagttcctgaaatctgttatgaggaaaaatattcctataggataaaaacaatagtgggggctaatatatatggaaaatactacactaaaaagtttgcatacattatttcctttggttttcacaatcatcttaaataatacccggcttgactgtaggaatcttaacagaccccaaaggccgcagctcatttccaaatgcctggtcagaattttcctttttgtaagtttgtatacttttttgctggcttaatttctctttcctcaggtatactccaacacaatacactattaagcctaactactggtaaggtagagtcaaattctgttacaaaaagttccatatgacccctctacgctacatgacatggtagcaaacgaaaccatgacaggcagctgtgacgaaaatagctatacatttataatttaaagtaatattcctggctagaatttattggaaaggaaatatcaaatattggagctagaagagactttagggacactaatcaaaacaaaattttattgaacataaataagatgcatttttactgtaaactttccagtcattattgttgttcttaaagtttagcaagtttgggaagagaagctggaactcttggttttacatcaaaaccaagatcattaattttcctacagtatactaggattccttctattttatatttttgtgtaacccaaattactctattaaatagtagaaatttagagctagacaaaatttctaatccatccatttatttttacaggcaagaaaacaaaggcccagtgtgtcaagtagttttatattttggttgcatacagttggttaccaaaagagttaggactaaaacccaggacttcattcacatccagtgcttttcagcaaaacaaaaaagtcaatgcttatcagtaagaattttaacaggccaggcacagtggctcatgcccataatcctggcactttcagaagccaagatgggaggatcgcttgaggccaggagtttaagacccacctgggcaacacagcaagaccccatctctacaaaaaaattaaaaattagcaggcatggttgcatacacctgtagttccagctactagggaggctgtggcaggaggatgtcctgagcccaggagttcaaggttgcagtgcgctatgatcgcactccaacctgggtgacagagtgagaccctgtctcaataattttttttaaaaaattataataacagttatcacttatcaagcacctattatgagcctagcactactatattaaggattctatgtaattatctcaaatcctcccaacaacattaaaagtccagatctatctgcctccaaagccagctgtaccttctcttccatcatactgctttcataatcccaaggagaaatccaggttggtggggcaagtgggggacaggatggttgttttgtttctttttgttactactgaagttatccacatagagttacttcatttttgtgaaggacttaaaaatattaggttatgtacatgaaaaacacttttacttataaaaaagaaaaggcttccactgcatctttatgaaaacataaactaaaaaagttgtgaagactcacttatataagcaatcaaagactaattccttcctaaggaatgtgatttcaacacaaggctttcatttgacaacttggtttgttacagaacaaagacgtacatgtacacacacacacacacacacacacacacacacacacacacacacacataagactgaaaggaaatgtgccaaaaatgttaaaagccactactccccgacaactcataaccacagtgacctccttcaagaaatgagcacataacccaggatccagacaatcaagtttgccatccccctgactcctggctaccgtgatacattaagggatgaaaaactgacataaggaggaacacagagtcacctctgaaatttaccatataactggtgagaaggagtctatcttcctttcagacagtgagccgtgatgacgttgccctgaggctataagcacacaacagaagcctgcttgagaatgaagccatggcaggtggaaacagagccagcccacacagcagaagaagacccttgacatcatcatcagggttctagatccacgcatgcctgagatcagtccatcttggactcccatttacttaatctaacatatccactgtcttttaattttttgcttgactgcttgagttggatttgtgctgcttaaatttttaatagtactgactagtctcagagagaagccctcagttaaaaaataacactacactgcaaaatttgaaacattttaaaattaggtcaattaatcattttgtctatctaaaatatacttttaaattactgtaacaaaacttttaaaattaaactagtaatacatttagtgttcctaaataaggttattctaaatctttatgtattagcaataattgcacttatttaccacatacaacatgatattttgaagtatatacacattgtagaatagttaaatctagctaacaaatgcattacctcacatagttatcatttttgtggtgagaacacttaatatccactatatctgcatttttcaagaatacaatatacatggccggatgcggtggctcacgcctgtaatcccagcactttgggaggccgaggcggatggatcacgaggtcagaagatcgagaccatcctggctaacacagtgaaaccctgtctctactaaaaaatacaaaaaattagccgggcgtggtggcaggcacctgtagtcccagctactcaggaggctgaggcaggagaacggcgtgaacctgggaggtggagcttgtagtgagctgagatcgcaccactgcactccagcctgggtgacagagcaagactccatctcaaaaaaaaaaaacaaacaaaaaagaatataatatacattaactgtagtcatcatgctgtacaataactgcatttttaaatagtattagagtgttacattgcctgatattttgtttgtattaacatttttctaatggtagaacataccacaactttactcccttggcttttcaaacttctgccataccactcaccaactataggttatgttaggtgggcagagatttcttcattcacactcccgggatacataaatagaagaggaagttctaaaaccgtgatgattctgccttctccaaattcacagagaacatcacaaccatcacagagaaattccctcttttttcctcttctgttcctcagtaattcttccttccctctgctcatccctcatgctcaccttccctctggaccaactgggagtttgcctctcctcctttcaaagattaaccccatcacctatgttctcatctcctcccaaccttcactccatcttattctttctctgccagctatagtatttcctaccacactagcacgttcccctctgccatcacatatacaaaaattttctctaacttaaaaaaaatatttcacttaaccaagctgctcactttattgctctcctacttttcactgacagatttttcaaatgaatggtttaaatctggtatttaagcatcactcttcccttattccccaaaagtctagcttcctccctcccctcaaatccctgaaactgaattcatgatatttcttttattgtcaaatccaatggcccctttaatttcatttcctcatgcacaccgctgtatgtggcgttatttcactatcctcttgtaaaatcttgcccattggttcaatgacattataatccattttagctctcttgctgttggacttctctaaagaggtctccttttcctctcattccctgttagtaaagtgtgtgtttctcatattcattcttcagtccattcttcaatgttcattttccatatgctttctctgaaaaattatatctatcattaaaactgtgttgttctccaatataaggcaaaattacaacacacatacaaaagggtgaataaccattttccttcccaaattaggactactcccaaattttctgaaaatggcatcacttgtcttccctaaaaccatggcatgcacacacacactcctcagcatgcttcctattttctattgcctagaacacccttcttcccttctcacccaaaaaaattcctatcagtctcaaatgccccttcctctgtgaagcctttcctgccacacacccatcacccaatgaacatgacttcctagttctcccttctatagaaccatggcactaagtagatacctttactatagcactttttaaatgattttaggttgctatgtttttcatctcacccaataactatgtccaggtgcaaggagcacgttttattctttttgtttctttagttgctataacatgataggcatgtacttggtaagtatttattaggggaaaaaaaacacttgaaaggtcccagttcagaatgtcagaagcataatcaagacacttcatatacctgcagtgctttgcaagcatcaaagttgaaagtgctagctttgtgaataccaaaagcattaactgactacaccagtcatttagcattttggtttcctgccacaaatatacttccatctttacatgcatatgtgtcttatcttcttaaatgggtaagtactttcagactacaacttttaatgttaagtacattgtattatctagtgtgattccttgtaccttagtagggtctcaataaatatcacatagctatttgatgtgtctcattgttaggagttctaaaactatctgagagatctgtcattaacttattgttttaaattaaatcagtttttcaaaattactcattaaggaaaatatgcatacatggaactcaaataccttcaaatccatgatccaaataatatattaacttttaaaaagaaaaggcaagagtgggttctttcagtggtagtaatgcatctttccttgcaaatatggatctcaaatatggattacatatggccattaaaaagcaatttccctataattcataacgtaaaaactgattcaggcaatatcatcaatggaggtaaaaggctattgggaacaatcatcccacagatttataaatgagaaaaatagggagcagttccaagatggccgaataggaaaagctacagtctacagatcccagtgtgagcgacacagaagacgggtgatttctgcatttccaaatgaggtaccaggttcatctcaatggggattgtcggacagtgggtgcaggacagggggtgcagtgcaccaagcgtgagccaaagcagggtgaggcatcacctcacccgggaagcacaaggcgtcagggaattccctttcctagccaagtgaaggggtgacaaacagcacctggaaaatcgggtcactcccaccctaatactgcgcttttccaacggacttagcaaacggcacaccaggagattatatcccatgcctggctcggagggtcctatgcccacagagcctcgctcgttgctagcacagcagtctgagatcaaactgcaacgcggcagcaaggctgagggaggggcgcccgccattgctgaggcttgagtaggtaaacaaagcagccgggaagctcgaactgggtggagcccaccacaactaaaggagacctgcctgcctctgtagactccacctctgggggcaaggcatagccaaacaaaaggcagcagagacctctgcagacttaaatgtccctgtctgacagcttggaagacagtagtggttctcccagcacagagcttgagatctgagaacagacagactgcctcctcaagtgggtccctgacccccgagtagcctaactgggaggcaacccccagtaggggcagactgacacctcacacggccgggcacccctctgagacgaaacttccagaggaacaatcaggcagcaacatttgctgttcaccaatatttgctgttctgcagcctctgctaatgatacccaggcaaacagtgtctgaagtggacctccagcaaactccaacagacctgcagctgagggtcctgactgttagaaggaaaactaacaaatagaaagacatccacaccaaaaacccatctgtacgtcaccatcatcaaagaccaaaggcagataaaaccacaaagataggaaaaaaagagcagaaaaactgaaaattctaaaaatcagagcacctctcctcctccaaaggaacgcagctcctcaccaggaacggaacaaagctggaaggaggatgactttgacgagttgagagcagaaggcttcagacaatcaaacttctcagagctaaaggaggaagttggaacccaacacaaagaagttaaaaaccttgaaaaaagattagatgaatggctaactagaataaccaatgcagagaagtccttaaaggacctgatggagctgaaaaccatggcacgagaactacgtgacgaatgcacaagcttcagtagccgattcgatcaactggaagaaagggtatcagtgatggaagatcaaatgaatgaaatgaagcgagaagagaagtttagagaaaaaagaataaaaagaaatgaacaaagcttccaagaaatatgggactatgtgaaaagaccaaatctacgtctgattggtgcacctgaaagtgacagggagaatggaaccaagttggaaaacactctacaggatattatccaggagaacttccccaatccagcaaggcaggccaacattcagattcaggaaatacagaaaacgccacaaagatactcctcaagaagagcaactccaagacacataattgtcagattcgccaaagttgaaatgaagggaaaaatgttaagggcagccagagagaaaggtcgggttacccacaaaagggaagcccatcagactaacagctgatctctcggcagaaactctgtaagccagaagagtgtgggggccaatattcaacatacttaaagaaaagaattttcaatccagaatttcacatccagccaaactaagcttcgtaagtgaaggagaaataaaatactttacagacaagtaaatgctgagagattttgtcaccaccaggtctgccctaaaagagctcctgaaggaggcgctaaacatggaaaggaacaaccagtaccagccactgcaaaaacatgccaaattgtaaagaccatcaatgctaggaagaaactgtatcaactaacgagcaaaataaccagctaacatcataatgacaggatcaaattcacacacaacaatattaaccttaaatgtaaatgggctaaatgctccaattaaaagacacagactggcaaattggataaacagtcaagacccatcagtgtgctgtattcaggaaacccatctcatgtgcggagacacacataggctcaaaataaagggatggaggaagatctaccaagcaaatggaaaacaaaaaaaaggcaagggctgcaatcctagtctctgataaaacagactttaaaccaataaagatcaaaagagacaaacaaggccattacataatggtaaagggatcaattcaacaagaagagctaactatcctaaatatatatgcacccaatacaggagcacccacattcataaagcaagaccttagagacctacaaagagacttagactcccacacaataataatgggagagtttaacaccccactgtcaacattagacagatcaacaagacagaaagttaacaaggatatccaggaattaaactcagcgctgcaccaagcagacctaatagacatctagagaactctccaccccaaatcaacagattatacattcttctcagcaccacactacacttattccaaaattgaccacatacttggaagtaaagcactcctcagcaaatgtaaaagaacagaaattataacaaactgtttctcagaccacagtgcaaccaaactagaactcaggattaagaaactcactcaaaatcacacaactacatggaaactgaacaacctgctcctgaatgactactgggtacataacgaaatgaaggcagaaataaagatgttctttgaaaccaagagaacaaagacacaacataccagaatctctgggacacattcaaagcagcgtgtagagggaaatttatagcactaaatgcccacaagagaaagcaggaaagatccaaaactgacatcacaattaaaagaactagagaagcaagagcaaacacattcaaaagctagcagaaggcaacaaaataactaagatgagagcagaactgaaggagatagagacataaaaaacccttcaaaaaatcagtgaatccaggagatggttttttgaaaagatcaacaaaattgttagaccactagcaagactaataaagaagaaaagagagaagaatcaaatagacacaataaaacatgataaaggagatatcaccaccgatctcacagaaatacaaactactatcagagaatactataaacacctctatgcaaataaactagaaaatctagaagaaacggataaattcctcgacacatacactcccccaagactaaaccaggaagaagttgaatctctgaaaggaccaataacaggctctgaaattgaggcaataattaatagcttaccaaccaaaaaaagtccaggaccagacggattcacagccgaattctaccagaggtacaaggaagagctggcaccatttcttctgaaactatcccaatcaatagaaaaagagggaatcctccctaactcattttatgaggccagcatcatcctgataccaaagcctggcagagacacaacaaaaaaaagagaattttagaccaacatccctgatgaacatcgatgcaaaaatcctcaataaaatactggcaaaccaaatccagcagcacattaaaaagcttatccaccatgatcaagtgggcttcatccctgggatgcaaggctggttcaacatatgcaaatcaataaagtaatccagcatataaacagaacaacgacaaaaaccatgattatctcaatagatgcagaaaaggcctttgataaaattcaacagcccttcatgctaaaaactctcaataaattaggtattgatgggacgtatctcaaaataataagagctatttatgagaaacccacagccaatatcatactgaatgggcaaaaactggaagcattccctttgaaaactggcacaagacagggatgccctctctcaccactcctattcaacatagtgttggaagttctagccggggcaatcaggcaggagaaagaaataaagggtattcagttaggaaaagaggaagtcaaattgtccctatttgcagatgacatgattgtatatctagaaaaccccatggtctcagcccaaaacctccttaagctgataagtaacttcagcaaagtctcaggatacaaaatccatgtgccaaaatcacaagcattcttatataccaataatagacaaacagccaaattatgagtgaactcccattcacgattgcttcaaagagaataaaatacctaggaatccaacttacaagggatgtgaaggacctccttcaaggagaactacaaaccactgctcaacgaaataagagagaatacaaacaaatggaagaacattccatgctcatggataggaagaatcaatattgtgaaaatggccatactgcccaaggtaatttatagattcaatgccatccccatcaagctaccaatgactttctttacagaattggaaaaaactactttaaagtacatatggaaccaaaaaagagcctgcattgccaagtcaatcctaagccaaaagaaaaaagctggaggcatcatactacctgtcttcaaattatactacaaggctacagtaaccaaaacagcatggtactggtaccaaaacagagatacagaccaatggaacagaacagagccctcagaaataataccacacgtctacaaccatctgatctttgacaaacctgacaaaaacaagcaatggggaaaggattccctatttaataaatggtgctgggaaaactggctaaccatatgtagaaagctgaaactggatcccttccttacatcttatacaaaaattaattcaagatggattaaagacttaaatgttagacctaaaaccataaaaaccctagaagaaaacctgggcaataccattcaggacataggcacgggcaaggacttcatgtctaaaacaccaaaagcaatggcaacaaaagccaaaattaacaaatgggatctaattaaactaaagagcttctgcacagcaaaagaaactaccatcagagtgaacagccaacctacagaatggcagaaaatttttgcaatctactcatctgacaaagggttaatatccagaatctacaaagaactcaaacaaatttacaagaaaaaaacaaacaaccccatcaacaagtgggtgaaggatatgaacagacacttctcaaaagaagacatttatgcagccaagagacacatgaaaaaatgctcatcatcactggccatcagagaaatgcaaatcaaaatcacaatgtgataccatctcacaccagttagaatggcgatcattaaaaagtcaggaaacaacaggtgctggagaggaagtggagaaataacacttttacactgttggtggcactgtaaactggttcaaccattgtggaagacagtgtggcgattcctcagggatctagaactagaaataccatttgacccagccatcccattagtgggtacatacccaaaggattataaatcatgctgctataaagacacatgcacacgtatgtttattgcgacactattcacaatagcaaagacctggaaccaacccaaatgtccaacaatgatagattggattaagaaaatgtggcatatatataccatggaatactatgcagccataaaaatgatgagttcatgtcctttgtagggacatggatgaagctggaaaccatcattctcagcaaactatcgcaagcacaaaaaaccaaacatcgcatgttctcactcataggtggcataggtgggaactgaacagtgagaacacttggacataggaagggggacatcacacaccggggcctgttgtggggtggggggaggggggagggatagcattaggagatatatctaatgtaaatgacgagttaatgggtgcagcacaccaacatggcacatgtatacatatgtaacaaacctgcacgttgtgcacatgtaccctagaacttaaagtataaaaaaaaagagaaaaatatatctttacagtgaagagatccagcagtcaccttcttgattaagtatgtatcatgtatgcagtattctcaccaaaaaaggttcaacctgaatctaacaatgaggaaaagctggacaaattcagaatgtgggatattcacaaaacaagtgatataaaaccctcaaaaaaattagaatcaaaattgggttcagtgtatattgcttgggtgatgggtgtaccaaaatctcgtaagtcaccactaaagagcttacttgtgtaaccaaataccacctgttccccaaacgcctatggaaataaaaaaaaaagaaaaaaagtacataataaaaaaaaaattagaatcagtgtcatagaaagcaatataacgttagatttttattttctagaataaaacagtctcaggtgacataaccaaatatagtgtaaggaccctggattttaaaaaatttataaacttttatggactaccatattaggcataattatgaaatatgatttttcttagttgtgttaatgatactgtgattatgaatagcctaaccttggaaattcatgctagaagaacttagagataaagtgatatctacagcttccattcaaatgattcaattaaaaattttaaagagtatatggactgggcacagtgactcacacctgtattcccagcatttttggaggccaaggcaggaggatcacttgagcccaggaggtcaagattagcctggacaatctagtgagaccccaactcttaaaaattaaaacattagccaggtggtggtgcacacctgtagtcccagctacctgggaggctcattcaggaggattgcttgagcccaggagttagaggctgcaccaagctttgatccactccagcctaagcaacagagtgagatcaggtcacaaaataaaatttttaaatatatgtaaagcaaatgtgacaaaatgttaaggatatttttgtgctcatgaacacaatacattcagcttttctatatatttttaaatcttcaaaataaaaagttaaaagggaaagtaatattctcttctttccaatcactgtaaacattagtaaattgatagaggggcttatcttgaagagatttagtttagattaagtatagaaccctattatatctaacatttattttaaatacttttacaatataaataaactaacctgagaatataagctataaaaacataactttacaatctaagaataaaacaaatggaaaaaattcttcctcattctacatataaaattttgtagttcctagaaataattattggtcagaaaactcttcttaccaatgtttaatagaacacatattcatgaatattcttgagcttacatcttccaatgatacacagtcatcccatgatcctaacaattcatgacctttggaatcacaaatcttatttttactctgcatcaaatgttctcccccaaccccactacctgcctctgttgccaggctgccatcttatcagcctcccaaattcaacttaactgtcactccattagctatctatcactgcataacagattaccacaaaacttagcactttaaaataacaataagcctttatgatctcacagtttctgttgggtcaggaattcaagaccagtgatgcataaggcatagcaaaactacgatcagcactcctgttcaaacaaaggacaattaggaggtgtgtgggagtcactgacccatagcaattctgaaatccagcaggtgttttgaggcaacactttggatctttctaagatcttaaaggactttaaagtcacaacttcaaaacacctggatatttctaaggtcttaaaggacattaaagtcacatcttcagcttgatctgtagatcaagttttcccatgagggtcctagattggatcttttctagaacccatttcttaattttagtatcaatgatcatacgaagaggctgggaattttcaagccctacagttccctgctcttttttctttaatagtatttcattttgcttatctctctccttttacattttatacataagtagcaagaagaaaccaggtagcttcttcaacattctgataagaaatctccttagctagatcacttcattcataggttacatttttctattttccatcttattgcacatgacagagttgctaaactttctgccaccacagaacaaggatcccctttcctcgtgtttccgttaatatttttctcactttcctttaagccctcgagcaaagccttctcaaaggcttctacttctactcaaacttctactaacagtcaactcaaggctctacatgctttcactaatgtttcaaaatccttcaagcttgtagccagttccaaattcaaaagacagtactacatttttgttacaacaaaacaaaaccactctgataccaaaatctatattgcttttttttttttttggcaggatctcattctgtcacttttagcacaatcttagctcactgcaacccccacctcccaggctcaagaacttagagatagcgatcctcccacctcagtctcccaagtagctgggaccacaggtgtgcaccaccacacccagctagttgttgttgttgttgttgttgtagagatgaggtttcaccatcttgcccaggctgatctcgaactcctgagctcaagtgatccacccacctcagcctcccaaagtgctgggattacagctgtgtgccaccgtgccctgctcaaaatctctattatctattgctataattacccccaaaattagtattttcaatacaataaggttttattatacagtttctgtgggaaaggagtgacttagctaggtggttctgcaccagggtctgtcatgaaattgcagacaatatgttagccagggatgtagtcatcagaagaccctacttggtttctactatggcttgctcatatgatggaaaagttcatgatagtttttggcttataattccatttctggtgggaatagcagcttaatggccattccacctttagatgagtcaagatggtgtttttctaggtcacatagcagtttgaattgctttttgaactagcatatcaacagcttatcttccacattttaaatcacaacatttgagtaattcatagtttcactaaaacatgtaaaaactcagtagtgatgatcaaaagctgagggtatctcaggcaaaaggggatagctggtcatgttccactagatccctaaaccaaagacacagggtcactaacataacatggtaggcaccaccctactgtttctgacactacctttagttctactactgcaactattatttatattctgagaaaaatttttaaatagattacataaagttaaaattaaatgatatcaagaaaaggcatctaaaatgtaggatacatgactagtaaactagaaaagataagaaaagcatacaggcaaagtaaaacaacacaaaggcagaacaaaaatccaccgtagaaagaaatagtttctatcaagagaatagaaatctgaatcagtgaaacagaagacaaactacaaacattcatggaaaattaagggaaaaaagataaaacataaaacttataaagggagaaagggcagataaggaggataggctacaaatgtctaatcaaagataataaggtgctatgctaccatggtggattacaggaggccataaattccttatcattcttcctatgaggaaatggactccatttcccctcctcttgaatctgagctggtgaatcttgtgacttgttgcacgagtaaaatgtattggaacaatgatctgccacttctgcaactagtctttagaagaactggtggcttccattcttagaagttagtaacatgctctaaagtaatccaggatgacctgctagagagaggcaacatggaggcgaactgaggcactctgagccaacattcaagcaccaaggacccaaatacaggaataaaccattctaccatcttttagttcagtgcagctacccttctaagtgcacccataggaatgactctaggtgacatctccaagagaaccatggactcaaaccacagaatcatgaaaaaaagataaattgttgttttaaggcaataaacattggggtagtccattacacagcattggtaactgatgtagctataatgatctacaacaacacgacactgccaaaatatatgaataatatctgtagtctgtagtataagatacttgtatttcaagaccctgctagaaaataatattttaaactgtttgaggccaggcgtggtggctcacgcctgtaatcccagcactttgggaaactgaggtgggcgaatcacttgaggtcaggagtttgtgaccagcctggccaacatggtgaaaccccatctctactaaacatgcaaaaattagccaggcgtggtggcacatgcctgtagtcccagctactgaggaggctgagacaggagaattgcttaacctagaaggcagaggttgcagtgagccaagatcgtgccactgcactccagatgggtgatagagtgagactctgtctcaaataaataaataagcaaacaaacaaacagtctgaaaacccagcttgtttcaaaaacctggctgaaagtaatagctttttaatttcttaaactatcttccattatttacttacttgaaaaaatattctgaattctatccatgaattaactcaggcatggaagataaatgctaaattgtaatattgcatcttcaaattttattgacatctattttaagatgtttaaagaagctgtcttaacaatcccacttaggtaagtatattctcattctttgcttcattcattcattcaacagtttttgaggacttactatgcacaaggaaactacgaagtaggattgagagcagattaaaactggatcactcccctaactttctagaaagtcaacccctgcttagtctgcacttccacagcactttatacaaatctcgattttgcagaaataataacagcagccaacatttatggaacacttactatgtacctggcaaaattctaagtcattattacataatttaactcagttaatcctcacaataaccttcatgaggtagataggtactattacccccattttatcaatgaggaaactgactcatcttgaagtcttttttccccactagactctagactccatgagggcaagtgtttcttcatctcagtatctcacacatcccagtttctggcacatatttcgctagaagtaaataaagaaattagtttgtccaaaaactagatacaaacatgctcatttacaagaacaattttttactcctcaaaagtataaggcaataacacttttttggactaagaaaaaatggcttggtgttgaataaatatagtatctctaactggtaagaaaacttaacataaagtttacccaacaattgatgaaaacaattaagacttaaattttttaaacaagtctaatttgataattttattcagcaatatgttatgcagaagtccataaaaatcacaatgacaggcgccaagatggccaaatagaaatcgctgtggccagaggctcccaccaagaacaaaaaaggccagtgaatcctgcaccagcaactttgagatatccaggttctctccatgggactgactaggcagttggcgcgacctatggagagtgaggaaaagaagggtgatgcaatggcccacatgggagccacaatggagaaaggggagctcccaccctcagccaagggaggcagtgagtgactgtgctaccctgcccaggaaaccatgttttttccacagatctgtgcaacccgtgggtcaggtcaggatatcaccctcatgagccgatgccaccagggccttgcgtgccaagcgcagagctgtgcagatgtttggcggtcactcaactggagaatgcctaagactaccgaattcccagggaaaggggccaccgtcatcactgcggctgcctgctgtccaagacgactaagctccccagggaagggagagcagccatcactgcagctgcctgctgcctaagatgactgagctccggaggggcagcagccagcactgtagctccagttggccgttttttccctgctggtgccagggagactggacggtttggacccaggagaaattctccacagcaaggacagcggctgtggcagactgtggccagactgcctcttcaggccagatcctgacccatccctcctcactgggcagggcctccctgcaggaattttagcaactccagcaggggtttaggaatggaactctgctctccctgggactcagcccctgcggggagaggcagtagctgtctctgtggatcagcagacttaagtctttctccctgctggctctgaggaatccaggtagtccagaggagtgtgacaatccccagcacagtgcatcccctccgccaagggacagctggacgatttcattaagcaggtcctggatcttgtgcctcctgactgagagagacccccccaacaggggtcgccagacaccttatataggagcattcctgctggcatcaggtcggtgcccctctgggacagaaatcacagaggaaggagtaggcagccatctttgctgttctgcagccccctctggtgacatctccaggtgtgggagggatccaaacgcacagggtctggaacgggcccccagcaaactgcagcagccctacgggagaggggcctgtttttttgttttgttttgagatggggtcttgctctgtcacccaggctggagtgcagtggcacgatcttggctcactgcaacctccgcctcccaggttcgagcaattctcctgcctcagcctcctgagtagctgggactacaggcgcatgccaccacgcccagctaattttttgtattttttagtagagacagggtttcactgtgttagccaggatggtctcgatctcctgatctcatgatccacctgcctcggcctcccaaagtgctgggattacaggcgtaagccaccacacccagccctaactgttaaaagagaaactaacagaaagcaacaacagcagcatcaacaaaaaagtccccacaaaaattccatctaaaggtcagcagcctcaaagatcgaagctggataaacccatgaagataagaaagaatcaacgaaaaaaacattgagaaccccaaaagccagactgcctcttctcctccaaatgatcacaacatctctccagcaagggcactcaactagacgaacgcttagatgaactgacagaagtaggcttcagaaggtgggtaataacaaacttcacagagctgaaggagcatgttcaaacccaatgcaaagaagctatgaaccatgataaaacatcacaggagctgttaaccagaataaccagtttagagagaaacataatgacccaatagaactgaaaaacacaacacgagaacttcacaatggaaccacaagtataaatagccaaagagaccaagtggaggaaagaatttcagagcttgaagactatcttcccaagattagagaaaaaggaatgaaaaggaacaaagaaaacctctgagaactatgggattatgtaagaagaccaaatctatgactgattagggtacctgaaagagatggggaaaatggaaccaagttggaatatatacttcaggatatcatccaggagaacttccccaacctagtaagacagaccaacattcaaatccaggaaatccagagaaccccagtaagatactccatgagaagatcaaccccaagacacataatcatcagattctccaaggtcaaaactcaaagaaaaaaggttaaaagcagccagagagaaaggccaggtcacctacaagggaagcccatcagacaaacagcagacttctcagcagaaaccctacaagctaaaagagattggggaccaatatacaacattaagaaaaaaatttccaacccagaatttcatgtccagccaaactaagcttcataggcttagtttggaaaaataaaatccttttcacaaaagcaaatgctgagagaattcaccactatcaggcctgctttgcaagagctcctaaagggagactaaatatgaaaaggaaaaaccattaccagccactgcaaaaatacactgaaatacaaagaccaatgacactatgaagcagctacatcaacacgtctgcaaaaccaccagctaacatcatgatgacagaatcaaattcacaaataacaatattaaccttaaatgtaaatgggccaaatgtcccaattaaaagacacagaatggctagctgcataaacaatcaagacccatcagtgtgctgtattcaagagacccatctcatgggcaaagacacacataagctcaaaacaaaggagtggaggaaaatttaccaagcaaatggaaagcagtaaaaagcagaggttgcaatcctagtttctgacaaaacagactttaaaccaacaaagatcaaaaaagacaaagaagggcattacataatggtaaaaggattaaatcaacaagagctaaccatcctaaatatatatgcatccaatataggagcatcaagattcataaaacaagttcttagagacctacaaagagacaaagactcccatataataacagtgggagactttaacaccccaccatcaatattagatagatcatcaagacagaaaattaacaaggatattcaggacctgaactcagctctggatcaactggacctgatagatatctgtagaactctccacccaaagacaacagaatatacattcttcttggtgccacatggcacatactctaaaatcaatcacgtaattggaagtaaaacacttctaagcaaatgcaggaaaactgaaatcctaacagtctctcagacaacagcacaatcaaatcagaactcaagattaagaaactcactcaaaaccacacaactacatggaaattgaataacttgctcctgaatgactcctgggtaaataatgaaattaaggcagaaatcaagaagttccttgaaatcaatgaaaacaaagagacaatgtaccagaatctctgggatgtagctaaagcagtgttaagagggaaatttatagcactaaatgaccacatcaaaatactagaaagatctcaagttgacaacctaacatcacaactaaaagaactagagaaccaagagcaaacaaaccacaaagctagcagaagacaagaagtaaccaagatcagagcagagctgaaggagagagagacactaaaaacccttcaaaaaaaaaaaaactaatccaggagctggtttttttaaaaaattaataaaatagctagaacgccagctagattaataaagaagaaaagagagaagaatcaaatagattcaataaaaaatgataaaggggacatcaccactgaccccacagaaacacaaactaccatcagagaatactataaacccctctatgcaaataaactagaaaatctagaagaaatggataaattcctggacacatacaccctcccaagactgaactaggaagaagctgaatccaggaatagaccaatacaggttctgaaattgaggcagtaataaatggcatactaaccaaaaaaagcccaggaccagatggatttacagctgaattctaccagaggtacaaagaggagctagtatcacttcttctgaaactattcccaacaattgaaaaggagggacttctccctaacttattttatgaggccagcaacaacctgacaccaaaacccaggagagatgaaacaaaaaaagaaaacttcagccaatatccctgatgaacattaatgcaaaaatcctcaataaaacgctggcaaagtgaatccagcagcacatcaaaaagcttactcaccacgatcaagtcagcttcattcccaggatgcaatgctggttcaacatatgcaaattaataaacataattcattacatcaacagaactaaaaacaaaaccacatgattatctcaaaagactcagaaaaggcctttaataaaattcaacatcccttaatgttaaaaactctcaataaattaggtatttatggaacatagctcaaatacaagccatttatgataaaatcacagccagtatcttactgaatgggcaaaagctggaaacatttcccttgaaaactggcacaagacaaggatgccctctcccactattcctatttaacatagtattggaagttctggccaaggcaatcatgcgagagaaattaagtgtattcaaacaggaagagaggaagtcaaactgtcttgtttgcagatgacatgaccctatatctggaaaatcccatcatctcagcccaaaagcttcttaagctaataagcaacttcagcaaagtctcaggatataaaatcaatgtgtaaaaatcacaagcattcctatacaccaacaacagacaagcagagagccaaatcatgaatgaactcccattcataattgctacaaagagaacaaaatacataggaatagagctaacaagggaagtgaaggaccttttcaaggagaactcaaggaaatcagagaggacacaaacaaatggaaaaacatcccatgctcatggataagaagaatcaatatcgtgaaaatggtcatactgcctaaaataatttatagattcaatactattcccattgaactaccattgactttcctcacataataagaaaaaactactttaaaattcatatggaaccaaaaaagagcctgaatagccaagacaaatcctaagcaaaaagaacaaagctggaggcatcacactacctgacttcaaactatactacatggctacagaaaccataacagcatggtactggtaccaaaacagacacatagaccaacggaataaaatagaaatctcagatataagaccacaggtctataaccatctgatctttgacaaacctgacaaaaacaagcaatggggaaaggattccctatttaacaaatggtgctaggagaactggctagccatatgcagaaaattgaaactgggccccttccttacatcatatacaaaaattaactcaatacagatttaaagacttaaacataaaacccaaaactataaaaactctagaagaaaatctaggcaattccattcaggacacaggcatgggcaaacttttcatgatgaaaacatcaaaaccaattgcaacaaaagcaaaaattgacgactgggatctaattaaactaaagagcttctgcacagcaaaagaaactatcatcagagtgaacagacaatgtacagggagaaaatttttgcaatctatccatctgacaaagggctaatattcagaatctacaaagaccttaaacaaattttcaagacaaaaaaaacttcattcgaaagtgggcaaagaacataaacagacacttttcaaaagaaggcatacatgcagccaacaaacatgaaaaaaaaaagctcaatatcactgatcattcaagaaattcaaatcaaaatcacaaggagataccacctcacaccagtcagaatggcaattattaaaatgtcaagaaacaacagatgctagtgaggctgtggagaaagaggaacacttttacaccattggtgggaaagcaaattagttcaaccattgtggaagatagtgtggctattcctcaaagacctagaaccagaaataccatttgacccagcaatcccattactgggtatatatccaaaggaatataaatcaatctatgataaagatacatgcaggtatgttcattgcagcactattcctgatagcaaagacatggaatcaacccaaatgcccatcaatgatagactgaataaagaaaatgtggtacatatacaccatggaatactatatagccataaaaaggaacaagatcacgtcctttgcaggagcatggatggagctggaagccattatcctcagcaaactaacacaggaacagaaaaccaaataccacatgttctcacttctaagtgggagctgaacaatgagaacacatggacacagggagtggaacaacacacactgtggcctgtcagggatgaggggagaaagagcatcaggataaatagctaatgcatgttgggcttaatacctagatgatgggttgacaggtgcagcaaaccaccatggcacacgtttacctatgtaacaaacctgcatgtcctgcacatgaatcccagaacttaaaaaaatcacaatgacaactattcaaatctgcatcataaagtattttaaaaggagtcagtgacagaggaataagaaaataagggataataaccattaaaatatgtggctttaagacaatccaagtaactgtaacacctaatacttcaaactatgtaatttggatatttttggctgaccattatttgggttggtagaggtggagtcataagctgtaaaacctgtgactatccgtttcattgcacactgtaacttaaaaacaacaatgaaaacccttatataattgacttgttacattaaaaattcacaatcctcagattaccggctacaaacaggaatttggattctacaaggggaataaaactaattgaaataatttaccaaacgtaccccataattcattatcacttcaggataccaaaactatcttttttttaagaagggagcatagccaggtgcggtggctcacacctgtaaacccagcactttgggaggccaaggcaggcagaacacctgaagtcaagagttcgaggtcagcctagccaacatggcgaaaccccatctctactaaaaatacaaaaattagccaggtgttgtagcaggtgcctgtaatcccagctacttgggaggctgaggcaggagaatcacttgaacccgggagacaaaggttacactgagccaagatggcaccactgcactccatcctgggcgacagagtgagacttcatctcaaaaaagaaaaaaaaaagaaaggagcataaacctagtactcctaggaccagacaaaatggctacatttcagaataatacccgacaagagtaaattttagagaatgttggtatgtcaaattttcaatctgacctctagaaaggctactgtctctcctgggtatctgattgagaactgaagtacaaacattagttacatttgccaaaactttttgtagcagactgctggttgtctaacacaacatcaattaccaaacccctttactcttgccatctcccgctacagaaattgaaagccaaatattcaccttctaacagctaggagtggcacataacccagttctggaaaagtaagtctgatagcgagcttcggagaaagcttttgcattcctaatataagggacagtgtggctgacaccagccatctcccatttgactgccttgaacagagatgtaatgcccattactacagccatcttgaaaccttgaagcaacaagtatatgaaaagcaaacaagctaacggtgatgaaccagagatagcttcaatctctgatgattctatcctgatctgctaactataaccgcccacctatacccttaagtggaaaaaaagaaaatgtccttttttgttgttactgttggctaggttttctgttattttcagcagaatgccaaccttactaagcatgcaaagactatgatgtacaattcctttaatttaaaaaagttctagtaattgtacaaacaaaaagcaaacattctgatgccaagtaagtgtgacaacaaattaaacccgggacaaattaaattaaatgttaggaagtcctaaataacttctcttaacaatttttatataaattaataaaatacatgcatttcagaaattttacaaaatacaaaataatataaggaaggaaaaaactcaatacccagaaataaccacttattatattttggtatatttccatccaattcatttttatacatatatcaacatataaaactatgcttttatctttataaactggaatcctgtaggatgttttattaactaatacaggtagaaagtgataactcagtagtacataaaagcatgtaagactcaaaaataaaagtatctcttccaccattcccatacacacaggaccacatatacacaagacctcattctccattccacttctcataaacagccacttttaatatttttggcattgtggatgtttcttgatttatcacctattaaccacatcaaatgacttcttactataaagattgagaaattaagataccctctgccctttcttcccaatttttgttactttcattttcatttttagcttttctactggtttgtattccacattaaaaaaatacacttaagcctctatttcttgacccaggaattttagatggaaatgtcttagctcctaactgtgtaagataaggaaattagtattcttacacagcaagcatttttaatcataaagtttaaccaaagaattaaaatatgactatttggtcttacccaatcctgagtgagaggaaaaaaatgtatgtacgtacttgtcgctttagtactatttcatttaagaaaaagtgttgaaaaatataggagcagtatcataatgaagaccaaatctagaaagcaactattagaacttggaaatcctataatgaatttttgtaattactacagacaaacatgaatttttaaattaagaaagatgaagcctgaggaagagagtacaacatgaaggtcagttgacaggaaaggaatactgatcaactcctcttttacactggtcttctccaaagagaaatatcataatgaaaacattgatattgatagttagcaagtagcttatcactttgagttccggtcagcatcagtgatttttgatcaatgtaaaagcatctgaagaatgttttaaaaacaacaacaacaacaacaacaacaaaacttaaaagggcaagtatcccgactgtctatatagaagtaaacaatgggtgagttaaatactaaatattagtaaagttgatgtcaaactagtaatattctacagattattaaatagttatttactatttaatatgtcccatgcagtctgataagagctaatcacacattatgagcttggattcctatacccatataaagtaggcacttttatcatctccattttacagaccagaaatttaagacagattaaggattgtgcccacagacactaataaatggcaaagccaggatttggaattcagtcccatcctcttaaccattacactcaaatgacatatataggtacagctgacccttaataacatgggtttaactgaatgactccacttgtacctggatttgcttcttctgcctcagccactcctgagatagcaataccaaccctttctcttcctcctcagcctacttgacttgaagacatcaaggatgaagacctttatgatgatccacttccccttgatgaaaaataatacattttcttaataacattttttctcttacttcattgtaaaaatacagtacattatatataaaatgtgtgttaatggactgtttatgttatccgcgaggcttccagtcaacagcaagctattagtagttaagttgtgagggagtcaaaagtgatttgcgcatttttgaccgtgcaggtggtctgtgcccctaactctagtcttgtttcaagcatcagatgtactttgaaattgtagatggacaagaagtaagaatagattcactaagagcaagttaagtcaaactagtcacttttttcgagttccaggttcccatggcatggataaatctccaagacatagtaagtgattacggtatcatttatgtaatgtgaggcaaaacagaaagatgcaatgtttacacagaataaagtgtaaaagtctcattttcttaattatcccccttcctatccctgcctaatctcttcaatccgaatctcttgacaaggggataatactacctataatttggcattttcttctagttcttaagtacttcttaaaaattttagctttatattggcatgacatacttggcagtggttatttctgagaaagaatatggaagaaaggaatcacacgataccctatatatttactgcttggctcttttaaaggagaatatattacttagataatacaaaatgttttcatcataatgatgctcaaaggaaaaaggtgaagagtttgtaagtatgacctcaatggtctccttgaatgggaaaagtctgacatattaaactacttaacaactaaaaaattttacaaggcaaaaatataccgtaacattaaaaggtatattcaaactagaaaaatattcacaacaaaaaagattaatcaaataaaggtattctcaatacacaaaaagctcttaccaataaataagaacataaaatttatacatgtttaaggataggcctcatatttaaaacttaactaagaacaagaataataattcatttaagcaacgttaaacctcagtaacaaagaaatgtaaaataaaacagcaatacaatggcaaaaactagaaagagtaacacccagcaatggctacggtataagaaagtagaacccttcacatattagtgctaggaatgtaaactggtaacatctggacaataaactgactttataaatgatttatataatcaaaacataataaaagttcccttaaagagtaaaactgagaaaaagtggctacagcctttaatcgcaccgaaggcccctacagtgacagactatgagaagaggctaacagtctcactgtgctttttccctgcaccgatcacatctgcagtaacagattcacttctgggcactacgctgtaagagaaacattgacaaactgagctatttccacagtaagataccaatacagtcagccctccatatctgtgggtttcccatctgtggattcaaccaaccacagatcaaaaatattcaggaaaaagaaatcatctgtactgaacacttacagacttttttcttgtcattattccctaaacaggacagtgtaacaaccacttacatagaatctttacatggcatttgcagtggattaggtaatgtaagtaatttaaagatgatttaaagcatacaggagggtgtgtgcaggttgtatgcaaatactacaccattttatgtaagggatttgagcatcagcagattttgctatctccaggaagtcctggaaccaaccccccgtggatactgggggacaactgtaccgtgtatgagagggctgcaaaccgtgtcttataataattataaacataataaagaattgagagcactttgcttagaaagagggattttagggaagacaggatagcaatctcgaaaaatccgaaggcctataaactggaaaacagaacttgttttatattgctcaggagggcaaacaaagaccaccagtgctcagagctgttaaataatgaaacagatacagtgcaactttagttgcccacaatatctaagataagtgatccattagaaacacagtagaaaagattcttcttataggcttagaaagttaggtttcatgaaatcagaggtactttaccgttctaagagtaaagcaaaaattacccttaaaatacgcattaatcttccaaaccataaaaactacaatattcccaatcttttattctacttacctaatttagataccttatttactagtccattctgggacaatcagggtacaacccactatctttgtcaggaataaccattcagtcaaatctaccaattcctaccctgtcagttctgttttgctacacaaaaatttgacagatatacaacatggttctagaattccagtgctgcccttaccgaaactctctcctgaacattaggctgctttcataactgtgatctagtctgtgtttcctaccttgcctcagctgtcccagttctagttccttgccctaatatctgtgacatactgttatctgaacttctagaatcattattttcttccccatttttgtatcacatactgattaagagactaccgtgctcaaaataatggtgaactgtatttcagaaggaaaattacaaactgtacaaaatataaagttgtattagacacagtgctgtcaaggaggttacaatggaaaggagaaataacagatctatgtaataacaaggcaatagaaagtcataaggaggtcaagacaggaaattgttgcaatattatacagacaaaagaaatcattctaattttgtaagaccatgatctgggtaaataatttggctttgaaggacacaggagatttttcacttaaaaagacagaggggaaaaaacatgccaagccgaaaaactagcataaccaaaaacacagaaaattagtggtaggtgcagggctatcacacatcaaaaggtaatgtgattgattataaaatgcgaacacaaactaaagaaagtttctctatgtcaaagggtatagaaactatggaaacagttactcaaagagagaaaacacaagttcaagaggtacagcttctctgcattctccactgggaagtagagcagtgaataatattactcacacagtgtgaggattccacaaggtggaagatactcccccttttccatactcagaggattttaaatctttccacccaaaacttctgagcccctcccccccaacaagatacaaaatattttttgaagaaattcaatctattcctaaacgtcaagaaagaaacaaaatctgaagtatctaagatcagcaaaaaagaaatctcaggtactaatcctggctctatacctaacttgaaatatggcctcagttttgaaatctgtcagatgaatggatataagactagagaggccaccaacagtggctcctgcctgtaatcccaacattttgggaggccgaggcatgaggactcctgaaggccaggagttggagatcagcctgagcaacataaaaagactcatccctaaaactaaaaaaaaaaaaaaaaaaaaaaaaaaaaaaaaaaaaaaaaaaaagactagataacttttaaagtcacttctaggttgaaattctacatatgagcttaagaaaaagctatctttctagataagtgattcaaactcggtttaaactattagtttcatacacctcataacttgtagtactcataatttctgataaatttttataaactgtactcctacttctcacaaacttcttctcctcataatttaagaattaaattggaatacagcagtatgtgaatcatgaagcttaaataaatttgtgtatctatacattaaaacacatacctagcaaaatttcacttccagtagtagtatagtaacttgtatcagactaacccttctatatataaaattataaactctgtataaaatataaagaatgacaatttgaaggcagtagaaaagctgcaaaagcaggcagaaattgaaggaaactgactgtaaagaagggagctacaaatgagattcgcactgatgtggctttttactcaaggcgctctcccattccttgaaactagagtggaatggctagaactcagaaagtcttactagtttgaagagacagagttcagagctgccaaaatagctggaaagtgagagggagatctcagtacagcacgttactgtactgaatactgtaggcaattgaaacatgttaagtattagtgtatctaaacatatctaaacatagaaaaggtacagtaaaaatatggtattataatcttatgggaccaccatcattagcaatctgttatggaccaaaacatcattatatggctgtatttgtccattttcatactgctataaagaactgcctgaggccgggcgcagtggctcacacctgtaaatccagcactttgggaggctgagatggctggatcacctgaggtcaggagttcgagaccagcctggccaacatggtgaaaccccgtcgcttaatgaaaatacaaaaattagccaggcacagtggcacacacctatagtcccagaggctgaggcaggagaattgtttgtacctgaaaggcaaaggtggcagtgagccaagatcacaccactgcacttcagcctgggtgatagagcaagactccatatcaaaaaacaaacaaacaaaaaaaacctgccagagactgggtaattaacaaaggaaagaagtttaattgactcatagttcagcatggctagggaggcttcaggaaacttacaatcatggcataaggtgagggggaagaaggcaccttcttcacagggcggcaggaaggccgagttaaaggggaagaaccccttataaaaccatcagatctcatgagaactcgataacacgagaacagcatgggggaaactgcccccgtgattcaattacctccgcctggtctctcccttgacacgtagggattacaatttttaagatgagatttgggtagggacacgaagcctaaccatatcaatggcacatgactatataaggaaacagcaagtcaaaataacaacaggtgacttttcatcagaaaccatggcagccagaagaaaatgaaatgacatatttaaaatgataaaaaaaccacaattatcaaattagaatcctatatacaatttaaaaaatccttcaaaaatgaagatgagcccagccacagtggctcacacctgcaatcctagcactttgggaggaaaaggtgggaggatcgcttgaggccaggagtttgagaccagcctggacaacatattgagactccatctctataaaaaaataatttaaaaattagccggccacatatacgatttttaaaactgtatataggattctaatttgatagtttggattctaatttgagccactgtggctgggctcatcttcattttgaaggattttttaaattgtacaggattctaatttgatagctggtgggaatgtaaattagttcagccgctgtggaaagcagttcagcaatttctcaaagaacttaaaacagaactaccattagacccagcaattccattattgaaaatatgaccaaaggaatataaatcatacatgtatcataaagacacatgtacacatatgttcatcacagcactactgacaacagaaaagacacagaatcaacctaaatgctcatcaacagcagacgaaaatgtggtacatacacaccatggaatattatgcagccataaaaaaagaatgagatcatgtcctttgcagcaacatggatggagctggagggtattacctaagtaaactaatgaaggagtagaaaaccaaatattacatgttctcacgtgtaaatgggaggtaaacactgagtacacatggacaatgtatactcgatgtttcaagaacacgctgagggtgtactttgtgtacacattgagtacacatttgagtacacactgtactttagagagtatacactgagagtgtattttgagggtggagggtgggagaaaggtgaggatcttaaaactacctatagggtactatgcttattacccggatgacgaaataatctgtataccaaaccccctcaacacgcaatttacccatataacatctaaccaataatgtattctggaaactaaaagtttaaaaaaaaaagctaaggaaaagttcttcaggtgaaaaaaaatatcagacagaaaatgaaatctataggaaaaaaattttttaactgaaaataggtatataagtgtaaatgaccatacttttcctgctctttttcaaaagacgtatgaataaggcaaaaaatatataacattataacagagtttataacatggtgatatactatacaggagaacaacagcacaaggcactctcagaagtgggggcaaatataaatatagcattggaagagtcttatattttatatggagcagtaaaatactaaccctacatagactgtaataaattaagaatgaatattgtaatctcaagaatagagttcctcaacctcagcactactaacattttgaactggaaatttttttgccatgggatactattccgtccattatagaacattcagcagcatatctggcctctacccactagatgccagtagcaatcccacccccacatcatttcaaacatgtctccagacattgccaaatgtcctctggggaccaaaatcaccctggttgtactttagagagtatacactgaggatgtattttgagggtggagagtgggagaaagtgaggatcttaaaactacctatagggtactatgtttattacctgaatgacgaaataatctgtataccaaacccctacaacatgttatttatccatataacaaacctgtacatgtattctgtattccactaccttagaacaatacctaaaaaagcaatgcaagctaaaatgatgacagaactgtttatcaaaggtttttccttggctcacctaaggagcctctttagaaaactccctctaaatcacttcggtccccaccaagaaattttaataccaaagatatatctgtttatataatgtgattggagagccacaaacaattgtaatataaaaggatattctgtacccttttccaagaacctatgattgccctataggagaattaccactcctgttgagaatgcatactgttagtggaatatactgaaaaaaattcaattaactcaaaagaagataagaaagtatgaagagaggtatttttttaaaaaaataacagtatgcctaagttcaaccacaccaacaataacattaactataaatttttaaattgctttaaaataagacacataaataacaagccaataggagagataaaataggatactgaaaagatactaaatcctaacaaaggcaaaaaaatagggaaaagatacaaagaacacatgacacaaacagaaaactcaatcatatcaataattacattaaatatgactggcctaaaaactcccatttaaaaggtaaagattgtcaaattagattttttaaaaaagacacgacccaaacatatgctgtcaacgagagaaacagtttaaatacaaaacaaagactaaatataataggacagttgaaaagatacaagatgcaaacactaatcataaaaaatcaggagttactatattaatatcacacaaactgaattccaagataaagagtgtcacttgagaaaaaggtgaacatttcataaggataaaagaagcaatacatcaagaagatataacaacaaaaaagcctctaataatagagcttcaaaatatataaaattaaaaaggtaggactaaagagagaaacagataaattcacaatcatagctggagactataacactgagtcacagaactagaggaaaaaaaaaaaacgagtcagtgaagacatagaagactatgacccattaccaatcatcttgactagatatttataacactatacccccaaaaaataaaatacagacagaccaaatgataagaccacataatggatcatttaaaaaatcattaaaaagttggctgggtgcagtggctcaggcctgtaatcccagcactttggaaggccaaggcgggtggatcacctgaggtcaggaattcaagaccagcctgaccaaaatggagaaaccctgtctctactaaaagtagaaaattagccaggcatggtggcacatgactgtaaatcccagctactcaggaggctgaggcaggagaatcaacttgaatccaggaggcggaggttgcagtgagctgagactgcgccactgcactccagcttggtgacagagcgagactccatctcaaaaaaaaaaaaaaaaaagatttcataaaatgaataaactcctagcaagattatcaaaggaaaaaagagagcaagtatataatttaccaatatcaggatttaataaggagatatcgctaagatcttacagacattcaaaagataagggagcctgtaatcccagcactcggggaggccaaggtgggaggatcacttgtgcccaggacgtcaaggtcagcctgggcaatggagcaaatcttggctctactaaaaaaataaaaataaggataagggaatattaaaaactttgcacccagtaacttagacgaacatcttggatgaaaaggaaatccttaaaaaatacaatttaccaaaaatgacacaagaggaaatagaaaatatggatagccttgtatctaaagaaatctcatttatcatcaaaaatcttcccacaaagaaagctccaacccacatggcttcactgatacattttgtcaaacactgaagaaaaaatacaatccaccttatgagaaacaagtgcttcccaacctattttatgaatccagcataaccactgtatcaaaactgaaaagaaatttacagatcaatactcttgtaaatgcaaaaaacccttagcaaaatatcagtaagtccaaattggtaatatatttttttaaatacaccatgaccaaatggaatttattccagcaatgaaagtaattcaccatattaagagaataaaaggaaaaaatcaaatgaccatttcaatagaagcagtaaaatctttagaaaaaactgaccaccactcatgataaaaactctccgaactaggaatagtagggaattttttcaacctgataaagggcagcaacagaaaaggaacagctaatgtgatacttaagtggtaaaataaatgctttcccaataagatgagcaataaagcaaaatatccactcttaccacttttattcaacaatgtactggaggtcctatccagtgaaatatgatcagaaaaagaaatcagaggcataaagattggaaaggaaaaagcagaactgtggatgttcgcagataacttgaccatctatgtagaaaatctttaaactaacattaataagtgaatttcatgagacttcaacttacaaaatcaatacataaaacttgattgttgattgagaaggagcaagtgtgtgtgtaacagcaactttacaattctataaataacttcaaaatgtatatgaaagcttatttgatggtttgctccatgtggttctattggttgaaactttcaaaaataatacattgaaactctaagaaaagctaatttcacagtattgtaaatacattagttaaatctcagagtttcaataccattagaaaataaatttaattttcttatgtttactctccatgtataacctcaacagtcaaagtgagcttctctaatgtaccatgtggtttacacagtcactaccacagctctttactctctatggaaaaagcttgctgctgggtagtaaacaggaaatcatactgtcattttctttctcctaatcattttataacttatttctaaagtcattttgtgaataaaaaatgaacaaaaaaaaacacatgcatgcacaaaataaaggagaagaaaagacccctggacttagataaacactcaaaaatgtaaattgttttctgtaacaacttgttaaatttgactagataacaagaatcacatcttacagcataaccaagttcacaatctttatgttgctaaagtatattttgctcagcagaattaagctatcttgtgagacaactcatagacacaaaatctttatcctggcattaccaaataccgacactgtagttcatctaaataaaccatttcatggaatataagaaaaatattattcaaaggacaaagtcagtacaaagaaaactaagggaaaaagttatttgaaagccaaaactggttacacatagagaatacaacatgaaagttcagtttgttagatactaatacaaaaagtagaataaagtaacacgagcatggaacattttcatcaaaatgcttttaatgataaaaatcacctcttagatttatgacaatctcaaaacagtaacattatgaattgactagttatacattatattttaacttattatcaaggaactagctttccacatttataaaagactacttaggtttttatgaaattttattaagcaaatgaaagttaataaattataataagcccttaattaatactattgcaatttatttaattctataatttagaccttttaaactggctaaatttcctactttattaatacactaagtaccttcatagcaaatattaccactagctataagggaaaaaattaagagaagtgctgaaatccaatttagagatttagagtcacctagaacatacctacaggctcgtctttgagtaagatcatttagtaagtatttaatatatacagagatgcctcctatgctgatgtgcaaccaagttgtaaggagctgtcctggatccatcaaggaggaaaacgcagacaatactttacttgatgtttgctccgtgatgtttcttttattgccatttctaacaccaacaatactatggtaatgtgttatctcaattaatacttatcattttcaactgtccagaaaagtgtaaaaaataggatatcactattaatatatcactaataaccaaggttaggaaagcatttatcctacgtaataatgaatatttatctttcagccctttttttattttccaagaagatatttactgaaaagcaacttactcacattaaaagtacaaatcagattatatctggagataacaacaattgatgcatatagtcttacgaaaaaagactaatattcaaagtaataactatattataactttattatatcaattttttgttgttgttgttgatgagacggagaacatgactccatctcaaaaaaaaaaaaaaaacagaaaatacaggaaaaggtccgggtgcggtggctcacgcctgtaatcccagcactttgggaggccaaggcaggcagatcacgaagtcaggagatcgacaccaacctggctaacacggtgaaatctcgtctctactgaaaatacaaaaaattagcctggcatggtggcatcccagctactcgggaggctgaggcaggggaatcacttgaacacgggaggcggaggttgcagtgagccgagatcatgccactgcattccagcctgggtgacagaacgagactccgtctcaaaaaataaaataaaataaaataaaaataaagaaaatccaggaaaaatagccacagtccaaactagaaaccaaattaaagtatggcagctctggagtacaaagagagcgtaagaaatccatttgttctccaatgagaacacacggacacaaggaggggaacatcacacaccagggcctgctgggggtggggggcaaggtaagggagagcatgaggacctaatgcatggggggcttaaaacctaggtgacaggttgacaggtgcagcaaaccaccatggcacatgtatacctatgtaacaaacctgcacgttctgcacatgtatcccagaacttaaagtaaaataaaataaatccatttgctctctaagaatctcatcataccactttgtttagtcatattatttatataatgtaatattttaactgcttttcagaatcagcaagtataactattataaaccttgacatataaaataaatgttacagttgaaaaactggaaagggaatgtgaggaattcaagggaaagatgaggagaaaagctaattttttttttttacaacttataaagtggcaagtttagagacaatgtctgaacactctaaagttaactgttaaacagctataagtttaatcataaaggcaaccaaaaaataaaaggaagaaggtaggatcagtattaaaagttaaatccttctatttttcacaatggggagatattaggttactgaaggttaaagtttagtatattatataaaaaactggcataatgatgagacaattaaaaataggaaaaaaagttctaaaatgattatctctgacaaaggaggtagaaaagatagggagatttttatttttcattttatacctttgtgtgttattcaaatttttatgtttatgcaactattcatctcaaaataagcacatacacattattagaaacacatacacatacacatctcaaaataaacacatacacattattagaaaaatgatggcaaattcttattcatttttttttctatagtccatggactaaatactttctattatggtatttcaaagatataattaattaaacagactaaagaatcatcctaaacctttgataaatatgtggagatagcaacagcttacattgtgttagaactgtcaaaataaatccacaaccatcatctcatttaaccctcaaaaccatcttgtgaaagcagattttagagattagtaaagtaaaactcaaaaaggttcaagtgatttgccatccccctccaaaaaaagtagaataatataaatacgtttaaaaagtaaatcaaaaaagcctttataaagcactgaaatctgaaaatgctttcgtaatttataacaggagaatgacattgaaagaaattacacttgacaatacaaatggtcaggcacatcggaaaacagctgggcagtttgttaaacatatacttcttataaagttaaacacacacttaccatatgacccagcaatatcattcctaagttattacccaagacaaatgaaaacacattacacaaagacatgcactctaatgtccagactctttattcgtactaaccaaaagctagaagcagcccaaatgtccaacaagtgattaacagataaactgtgatatatccagaccatgaactactactcaaccataaaaaaaaagctaatgatatacaagacatggatgaatattaacagtattatgctatgtaaaagaaatcagccataaaaaaactatgtactgcatgattccatttatatgaaattctagaaaagcaaaattatagtaacagcagataaagtggttgccagggttaagggatgaggactgggctgcaagggagaacaaaggaacctctcgggttaatgaaaataaccactatatcgttttcagagtgtttgttacactactgtgtatctctggcaaaactcatcaaattatgactttacattgcttaattttattatgtaagttacgacttaataaggctcatttaaaaaataatccataatcacatttaactatgacaacagcttttcaggataggtatttactacagaccttcaaaaaatattaaaatcaatattaggagggaacttgtaaccataaagtagatatacaggaactaaaaggttctgagaatggaacagtcctcatcctactcgacgtggccatgtgggtaaacagtagttgcctagcaactaatctaaactctaaatttctaataaatatattgaccacataagcaggtgatctcacagatgataaaccgctttacatcgaagggttcttcctttaataataaaaaataataatgtgcttaagttatttatctaaagtaggagtgaacaaggtgtattaaacctagatgatgaaaaataaaaatacgaaattaaacataaacatacacacacaaaaaatccttgtcctcatttggccttttacgtcaggactttacttaccaaatttatgggattaatccatgagtttgcgggtgaaccctttccccttttctactttaagccattcccctacaaccattcaaactggcttaattctcttatttatatatttacatgtgattaaatgcatataggatcgtacttttacatatattaaatgattctaaagatatctctccagattacagaacctgtagacaccacagaaaaatacaacactttctgtaacacgctacacacaacataccagaaagtcaaacctaacttaactagattataaatgctcaaaatcaagaattacaaaaaaatcccttaataacaagcaaattcctaacacacgttaaatatatcatttctctcttactagacatagcatgacacagtttaacagtatcagaaaaaagatcaacttctaagacaccactcactgctagcactcttaccaaccgtattatttttggtttgcggagcacttacccctcttctgaacccaaccttctttcacaatggtaacatcgctcatgatgactcccctctgagcccccaacttggagaaatggtactttgtgatatcagctttagggtttggattctctgctgctgctgcccttcccactctctagtgatgactcagcctggaaggaagtattgaagaaagaattttttttccattcttgcaactcacagagcaataacaaacaactaattctttgtaaatgtcttcaactggcctgacctcacataaaagtctggctcttcaaactggggaacttatttattaaatagttctataatgaaagcacttccctagtcttgtgaccaatttcaaatgatagtgaaacttttaacctaagaggttgcaacaaaaaagtcttaagaaaaccagtcacgcctacccaaataatagagaaaatttgtttggtgatgtgtatttgaggtgaagagggaagagaatgaaagttaattgccctaaatccctgtaatttcagaagcaattgtaaattttttgttttttttttttttgaaacggaatctcactctgtcgccaggctggagtacagtggcgcgatctctgctcactgcaacctccacctcccaggttcaagcgattcttctgcctcagcctcccaagcagctgggactacaggtgtgcgccaccacgccctgctaatttttgtatttttagtagaaacggggtttcaccatattggccaggctggtctcaaactcctgacctcatgatccacccgcctcagcctcccaaagtgctgggattacagaagtgagccaccacaaccagtcgtgaatactttaagtgatataaaatacaacgtaccaagaactcatcatttacgtattcttactctgcctgttccaagaaatattttaaggagattaaaaaataattgatttcatattatgtacttattataaagtaaagtgaaacaaagggaatatgaaagtagaaaaaaatatttagtactcaagatgtgccaagaactgttacgggtacttacatctattattcttatgtgatctttataaccttatgaggatactattaattccatttcacagacaaggaaactgaggctcacacagataaaccaacttgctcaatttcaacacacctagtaaatgtggagccaagatctgaacccaggctgtctgactccagagcctgcattccaaaactatactgccttaagataaaaagaagtcagagtaaaggcatacatacttgggaaagatacgtcacaaatttggcatggagctcttgggaagacaatgcaaataacaaaacacaacaggctttcctatttacagtatccaaaaaaaatttttttttgagatggggtttccccccatcatccaggctagagtagagtggcacaatcatagctcactgcagcctccaatgggggtcaagcaatcctcccacctcagcctcctgaggagctggactacaggcaggcatcaccatgcctagctaatttttaaaaaaaatttttgtggagatggggtcccgctatattgtccacgctgcacaaatttttttaaaaagcaaaaaaagttcctcagaagaaatacaacttttcctgggacaaacatcgaatttatcccatgggtcttcttcataagatgtatgcgggaaagtcctcaaaaacaccctcccatatacagcaatgagttttacagggtcattgcttattgtcactctcaaactaaaaaggaaaatgccaacataaaattagtaaatccatttgcacagaaggggaccaaaaaatgtggtccaggtacaccagtgttatgtggtcaagaatcatatcataaattttagataactagaaaaatggatagatggactacacaaacatactctctcaacttggtttgtgataaatgatacatagcagttaagttcagtgttagactcccaacctagcgctaaattagactacaggtcattcttcaatgcaaattaagtgtggagcttaaccatttaacagtcaggaatcaagactaaacattctctagacagcctgactaaatagcctgacaaaagctatgtagctgaatgcaagaccaccagcctcatgtattatgaggtcacaggcagaacctataggtaaggctgagactcctcaaaatcaccatgagtctgttgctgtagagtgtcaaaaagggatattagtttgtaatcccagcactttgggaggccagggcaggaggatcacttatgtccaggagttcaaggccagcctgggcaacatggcaaaacccatctccacaaaaaatacaaaaattagctgggagtggtggcaggcacctgtagtcccagctactcaggaggctgaggtgggaggatcacctgagcccaggaagtctaggctatgctgagtggtgaccgtgcctgggtgctacagtgagaacctgtctcaaaaaaaaaaaaaaagaaaagaaaagaaaaagaatttggttgcacagttggccatatttttgtaatatgcatgtaaaatcattttaaaatctgtcttgggagcctcatcataaatttttaaaaatccatacatacatataaaatgcaattgatatatggtccattaaataccaagaatcagcttgacagaatttacccccagattaaactgagctacccaataggtatggaatcctctaacaaggttcatcacaatggtgtattaggaagagcaccagaaagaccaagaaacttgagtccctgccccacccagagtgatgctgtataaggtcactttaattatctgtgcctcagtttccggagccataaaaatgaaagtatagcattagatgaactctgaatagctttatagctcttccagagctaatatttatgattctgcaagttaaaatctacggagtatctacttcatatatagatggcatcataagtgaaagacatgattatacatacatagttcatgtcctcaaaagtttgataattggaagataaaacattcaaacagcatttcaactaagacaaaatttgggctaagctccattattggaaaaatactgtcctccttcccctcccatcccctagtcccccaaatacagtcagaagctttctaatatagattccaatatacatgtaaaatcctcctaaaatctgtcttgggaatctccctaattataaatttttttaaatccatccatatatatataggaattatctaatatagggaagaaaaattatcatttgcaattctagtgttttcttctagtaaatctttttactttcctctcataatatttagaaatgagaaatacctgtagttggtgatagagtactgaaaagaaacagaactaaaaaacacatcaacaagtcaagaagcatatattaattttatctacccattagtattcaaagattacttggcagagaaaatgagtttacatctaatttgattaaagactatgatgctataataaaatctgtaaacatttgagttatttaatttggcattttaaacaaatgaaaggtgatgttaatgggccagtcaatacacttttattaacttgatgctatggaaattattgtaccaaattttgcaaatttagaattatcactgttaactgtaataataggtacaaacaagaaaaacactagaagtgttgcagaattaggaaagtttaaataaaaggtatttttagaatgccacaataagtttttcttatgtgaaaatcactttcaaaagtgtagcaggggttgtttgaaagattaaatgaatacaggtaaagcacatagaacagtgcctggcacatggcaactgcttaccaggcattggttagcattaactctaaactgaatctaatcctatcccatgtaaaagatcaggacaaagtatttgttgtcggaagattcaggactatctttccaaaagaaggtatgctgtgtgaccaggatttaaaatactgatgcacatgctgaaacctggagtaacacaaatcttctaacaaaaattaattgtattattaatgcatattaacttaaaaataaaaatgccagtcagatcacaagactgatttgctcaaaatgaaaatggtttttcagttcttgcattttgttgctcaaatctaagatagttttaaatttttctttttaacacttcaaaacttaatcacactataaagacaagctcctatcaaatcatgctaagcatccaactaacaagttgttaacagtgattgccttaccttcccaaggacaaattcttgaactaaaagatataataacaaaagaaaacatagctatcttttcacgaaaatacacaaagtttaagtaaaggctaaacttctacaaaatcaatttgtaaaacaggttcctcattttaaagaaacccagatagctggaaatttccactgaatttttatgagaaaatttctgatgtttacatcaaaagctacagcttaaaaaataagtccttactttccacaagtctctatgctaagtccatttgttccctagtaagtttaatcaacacgtttatttagatttgcagtgattctgaaaacagattccttctgacagtgattttctgaatgaaatgtaaatattaaaagtttttaattaaaccagcacacagttcacactccagtatttgttaaatataatcttatttaaaatattttacagctatgaaattaatttttaaaaagtccaaagcaaaaccttaaagtactctgacatatacaatttagagtcgatgtcaagattattaagccaaaaattaattttaaattggaaaacaattcactccagtaataattatggaaagaaaaccaaatgaatacaaataataatttcacaatttttgcaggattactttggactatttttaaaacgctgtaagaaaacatgctgcaaaaccacaatgcaaatacacaactgaaaactaaaaccctacattcatctaaatttcaacagtctcattcatgtaatatttgtcctccctcactttaaaactggaacctcaagccaatcaaagatattggggtcaaccctagtaaggaaaacaaaaagatcttcaagtaccatctccctgtaaactttcaagtactatctccttggtaaactttccaagtcaagataatgtactggcaaaaggaaaacaattacagtccggatatatatcttgcatataattgtgcattaagtcataaaccttggaaaactagtaacttagtaataagttgctattttaattataaaatattttcatgttttagacaaccacccccggaatgtttgtattcgtttatacatattttgcaagtgatactcaagttctgaagactaatcttcatttcctacaccatctttattagactcttccaccttcgttttcctaagtaaatacataacctaaaccaatgagtttcactcatttgtcagcttcaaccactgacaaaacccagtggttgcctagtgatgtatagttctactaaaagacatatatgaccatgctttaccaaatacggaacacatgtctaaactgttgagacaactgccaatgtattaactacaaaaagccattattttttactttagcctcaactaaaatcaaagtgtgaacactttattatggctagaaattacccaatatagatgcataggtttcactgttgactttctatttggaaacttcatcaattgcaaactaccaggctttcaaccaaaatgccacattggtgaaatgagttggttttattttcataacaacattattttgatggaagaaatgtgagcatcccagctttgacttgtgggtaagcatttcctctgctttcagaacataaacagtaaataccggtattggaaaaacctggccccaacgagattctttatctctaggctaactgtagattcccgggaaatcccaaacaagggatggtgaccccgcctcggcgtcagggtcaacacagcaaccagctaggcttcaactttgggctctgaagggccccaccggcatcatggctgatgcggaccgatgcgccggaggaggtggacaaggaagaggctggtctgtttacttgcagccagagctgccgccgccgccagcagcgacagcatcactggatcagccaaacccagcatcttccgcacatttctattcttagcacacaactcccaagcggatcaaaaccccactactattaaaaacacagacaagcacgttacccacctcccacacacacacccccccccccaccccaccagtgccgtcttttcctgcgcgccagtggcggggaagggtgggggaaggaaggagaccccggggacgcctgtgcatcctcgccttcaccccaccccacgcgcagacagcctcagcgccagggcgcgcggcagacggctccctccccccaacccaaacacactgacaccggcgctccacgcgttatataacctcgccgccgcccccggtccaggcgggcgccccctccccacgccgcgcggcccgggcggggaggggcgaggggaaggagcgagagttgcgcagacagcaggcgccgggccggggcagcccagacacagacggtaccgctaggccgggaacacccctcccccggcccgctgcgcaccgccgccccccagctttccccggaaagcggggggtgtcggtgtcaaccgcgctgggcatcccccggcctccacacccacacccgaagcctccggtgacccagcccccgcccacgcccccggcgcggtgacaacccagaagcccccgcctcaccccaccccgccgccatcccccgcctgagggaggcagggagggcggaccggggcccggggcccggagggagtggaggccaggcggggagggggctagagttgggggcggtggctgttacctgcaacggcggcggcggcggtggcggccccgcagctgctcgggcggcggcggaggatggagccgggggggggcggggggaggagagggggcgactcgggggtcccccctccctcctcctcccctcctgtcctccccccaccccacagagcctctggcctcctggagcccggtgcggccggcgggagggcaagcgaagggctgcaggggagggagggagggagccggccgggccgggccgcggagctggagcgggaggcggcggcggcggcggcggcggcgggagggggagggaggagagagggcggcggcggggagaggaggaggcggagactctacatgggaatcggatatcggctacaaattcatcaccagaaaacaccgctcgggcgggggccgggtcacgccggcggggcggcggctctgggccccggggcgcgcccggcgcggggaggggttctgcggcctcctcccgggctgcgcctcgctgaggggaccccccgccgcctccccgccccctccttcctcccgctcggggccgccgccgatcggttctcgccgtcgccgcggggcttgttgttgactttgaggaaaactcctgacgtcaggggctggctctcggcgactggcgggagcggcttccccgcgtccccggccctgcccgccgcctctgctcccctccctgcccggccctcgtcctcaggcttccccgcgcccccaaaccagcggtgccccgcgccccctctcctctcgcgagaacatccccctagccagccagagccgggagcgggggcagtcgctcccgggcgggaagttctgggtttccccctcgcccgcgtggcccttggcgggcacccgaggcccgggagcggaggctcctcgcccagccgcttcctcggcgcatccgcccacccgccctggccgcggacgcgcgcgccgccaggccccgggcgtctcctccagtccgccgcggccccttggggagatgggcccggcgcgagggctcgcacctggaagcccacgaagtgggcggtgcccaatgaggtagggaccggagagcgcggagcagtccagaagccgaccccaccccctgcacctcggggaagagggaacccgggtcagcccgtagcaagaatcattcctgactatcccaggagaccacggcagaccaaaaacacctctctgaacagccttccgcaccgctcgctgcaagcattcgtccacacacggtacacagattgcgggcggatcgtaattcactcttgaaatcacaccctttttagggatattcgttttcaatgactttgggaaagccacgaggtactacatttactacgaagagaccgtttctttattttgaagtcagtgactcctgagactgcattggggacaacttttttgcacaatgaccatattttaccatgcagcgcacttcagaaaattataaaagtttacaagttttatcgcttctggaaacacctgggcagcatccctattatcccgccacgtggctctagccttgttgatgtacctgttactttctcccactgcaacatttttgttaatgtctgtggcttctttctgcagaagagttcctcctcctgacatgcacttcattctctgcttttctatgtcttgacaactctcttatggtagtcattttcttatactgtagccccctggtatttatgtactgtgtggtattaatatttatacttccaggttcacatcttttatgaactgtgcatctgttgggattgtggacaggagtaggaaaccaaataaaagggttttttaaaaaagtcagttttctccgtttgtaagggaaacttgtctccctgaccaccctggagcaaaatttgccattttaagataacacagtccgtctgagagaaagtcctgcaccatgcctttccccttttcccatatttcccagcatgctatgagctgatgaataaacagactttgtcctattttcgttgtatctataaaatatacataatgtattcccataattatcagacctctcacagtcactattggtaaaattattgggttacaggtttcttgctgtaaaacacaaaaataggtcatatttttattccatagtaccccaacttgctttttatttttaagaaaatagtcccttatgacaccagcactaaaaagagtgtctgaaactttaaatacttaacttttgagagtcagagtatccggaattactgaattactagatatctcttatcagtgagatgttcatttgttcccaaatttaacatcaatatatttacaagaactgaatgtgtcttatgagccatactacctcaaaatatttctcccagtctggtcagattgcattaaatcttaggtggattaaaccctaaaattcagtatgtgagaatggattatatactctcggcttcatgtatttgaagaattataagtttttatttctgttcaatttttgcttgtggactatagtagtttcataagtttccataataaaagcatgtttgattttgttattgaattactattgattagggatattatttatttaaataacgttgttctttctcttagactatgccggtatgaatttggtagaatctgccgattgtggtatgtcggtactccatacagagtgtgtggcagatttcttctctattttgttatcacatccagtaatatggagtgcagccagcatgttcatccctgggaatgtccctcctaaattttgcaaagaaagccttcattctttattacaccaaatattcttaagattaacatttctcagtattagttatttattcattttaagaaaaatgttcattcttctttactaccaatgactaagtttgatactgagctatttcttggtacttcccccatttcttgggagtaactaaaactggaaggatatttagaatttcagagcatctaatgtcttagtccattcaggctgctataacaaaataccatcaactaggtagcttataaagaacagaaatttatttctaacagttctggaggctgggaagtccaagatcatggcaccagcagatttggtgtctaaagagggttccgtttcctggtttgtaggtggtgacttcttgctgtgtcttcacattttagaaagagtgagggaactctcttggacctctttttctttttctttgtttttttttttttttttttttttttttttttttt
